(12) United States Patent
Babe et al.

(10) Patent No.: US 12,104,187 B2
(45) Date of Patent: Oct. 1, 2024

(54) PROTEASE VARIANTS AND USES THEREOF

(71) Applicant: DANISCO US INC, Palo Alto, CA (US)

(72) Inventors: Lilia Maria Babe, Emerald Hills, CA (US); Viktor Yuryevich Alekseyev, Palo Alto, CA (US); Neelam S Amin, Santa Monica, CA (US); Joshua Roy Basler, Palo Alto, CA (US); David A Estell, Palo Alto, CA (US); Victoria Huang, San Mateo, CA (US); David Marquez, San Jose, CA (US); Jeffrey Wayne Munos, San Francisco, CA (US); Rei Otsuka, San Mateo, CA (US); Geetha Veeramuthu, Sunnyvale, CA (US); David Edward Wildes, San Francisco, CA (US); Michelle Jackson, Newcastle Upon Tyne (GB); Euan John Magennis, Newcastle Upon Tyne (GB); Eva Maria Perez-Prat Vinuesa, Newcastle Upon Tyne (GB); Philip F. Souter, Newcastle Upon Tyne (GB); David John Tarbit, Newcastle Upon Tyne (GB)

(73) Assignee: Dansico US Inc., Palo Alto, CA (US)

( * ) Notice: Subject to any disclaimer, the term of this patent is extended or adjusted under 35 U.S.C. 154(b) by 63 days.

(21) Appl. No.: 17/216,735

(22) Filed: Mar. 30, 2021

(65) Prior Publication Data

US 2021/0292728 A1    Sep. 23, 2021

Related U.S. Application Data

(63) Continuation of application No. 16/090,860, filed as application No. PCT/US2017/030800 on May 3, 2017, now abandoned.

(60) Provisional application No. 62/331,282, filed on May 3, 2016.

(51) Int. Cl.
*C12N 9/54* (2006.01)
*C11D 3/386* (2006.01)

(52) U.S. Cl.
CPC ............... *C12N 9/54* (2013.01); *C11D 3/386* (2013.01); *C11D 3/38609* (2013.01); *C11D 3/38618* (2013.01); *C11D 3/38627* (2013.01); *C11D 3/38636* (2013.01); *C11D 3/38645* (2013.01); *C11D 3/38654* (2013.01); *C12Y 304/21062* (2013.01)

(58) Field of Classification Search
CPC ...... C12N 9/54; C11D 3/386; C11D 3/38609; C11D 3/38627; C11D 3/3836; C11D 2/38645; C11D 3/38654; C12Y 304/21062
See application file for complete search history.

(56) References Cited

U.S. PATENT DOCUMENTS 6,831,053 B1 * 12/2004 Ghosh .................... C11D 3/386
435/219

FOREIGN PATENT DOCUMENTS

| WO | 2009/149144 A2 | 12/2009 | |
|---|---|---|---|
| WO | WO 2010/056640 A2 * | 5/2010 | ............ C11D 3/386 |
| WO | 2016/001449 A1 | 1/2016 | |

OTHER PUBLICATIONS

International Search Report and Written Opinion—PCT/US2017/030800—mailed Oct. 19, 2017.

* cited by examiner

*Primary Examiner* — Ganapathirama Raghu

(57) ABSTRACT

Disclosed herein is one or more subtilisin variant useful for cleaning applications and in methods of cleaning. One embodiment is directed to one or more subtilisin variant, including one or more *Bacillus* sp. subtilisin polypeptide variant, and one or more cleaning composition comprising one or more such variant.

10 Claims, 1 Drawing Sheet

Specification includes a Sequence Listing.

```
GG36   1 AQSVPWGISR VQAPAAHNRG LTGSGVKVAV LDTGIS-THP DLNIRGGASF VPGEPST-QD
BPN'   1 AQSVPYGVSQ IKAPALHSQG YTGSNVKVAV IDSGIDSSHP DLKVAGGASM VPSETNPFQD

GG36  59 GNGHGTHVAG TIAALNNSIG VLGVAPSAEL YAVKVLGASG SGSVSSIAQG LEWAGNNGMH
BPN'  61 NNSHGTHVAG TVAALNNSIG VLGVAPSASL YAVKVLGADG SGQYSWIING IEWAIANNMD

GG36 119 VANLSLGSPS PSATLEQAVN SATSRGVLVV AASGNSGAGS ---ISYPAR YANAMAVGAT
BPN' 121 VINMSLGGPS GSAALKAAVD KAVASGVVVV AAAGNEGTSG SSSTVGYPGK YPSVIAVGAV

GG36 175 DQNNRASFS QYGAGLDIVA PGVNVQSTYP GSTYASLNGT SMATPHVAGA AALVKQKNPS
BPN' 181 DSSNQRASFS SVGPELDVMA PGVSIQSTLP GNKYGAYNGT SMASPHVAGA AALILSKHPN

GG36 235 WSNVQIRNHL KNTATSLGST NLYGSGLVNA EAATR (SEQ ID NO:1)
BPN' 241 WTNTQVRSSL ENTTTKLGDS FYYGKGLINV QAAAQ (SEQ ID NO:2)
```

PROTEASE VARIANTS AND USES THEREOF

CROSS-REFERENCE TO RELATED APPLICATIONS

This application is a Continuation of U.S. application Ser. No. 16/090,860 filed Oct. 3, 2018, which is a 371 of PCT/US2017/030800, filed May 3, 2017 and is related to and claims the benefit of priority from U.S. Provisional Patent Application Ser. No. 62/331,282, filed May 3, 2016, which is hereby incorporated herein by reference in its entirety.

Disclosed herein is one or more subtilisin variant useful for cleaning applications and in methods of cleaning. One embodiment is directed to one or more subtilisin variant, including one or more Bacillus sp. subtilisin polypeptide variant, and one or more cleaning composition comprising one or more such variant.

REFERENCE TO SEQUENCE LISTING SUBMITTED ELECTRONICALLY

The content of the sequence listing electronically submitted with the application as an ASCII text file (Name: 20210329_NB41117USPCN_SeqLst; Size: 895 KB; Created: Mar. 29, 2021) forms part of the application and is hereby incorporated herein by reference in its entirety.

A protease (also known as a proteinase) is an enzyme protein that has the ability to break down other proteins. A protease has the ability to conduct proteolysis, which begins protein catabolism by hydrolysis of peptide bonds that link amino acids together in a peptide or polypeptide chain forming the protein. This activity of a protease as a protein-digesting enzyme is termed a proteolytic activity. Many well-known procedures exist for measuring proteolytic activity (Kalisz, "Microbial Proteinases," In: Fiechter (ed.), Advances in Biochemical Engineering/Biotechnology, (1988)). For example, proteolytic activity may be ascertained by comparative assays which analyze the respective protease's ability to hydrolyze a commercial substrate. Exemplary substrates useful in the analysis of protease or proteolytic activity, include, but are not limited to, di-methyl casein (Sigma C-9801), bovine collagen (Sigma C-9879), bovine elastin (Sigma E-1625), and bovine keratin (ICN Biomedical 902111). Colorimetric assays utilizing these substrates are well known in the art (see, e.g., WO 99/34011 and U.S. Pat. No. 6,376,450, both of which are incorporated herein by reference).

Serine proteases are a subgroup of carbonyl hydrolases comprising a diverse class of enzymes having a wide range of specificities and biological functions. Much research has been conducted on senne proteases (e.g., subtilisins), due largely to their usefulness in cleaning and feed applications. Although a number of useful variant proteases have been developed to address needs relating to these applications, there remains a need for improved proteases.

One embodiment provides an isolated subtilisin variant comprising an amino acid sequence comprising a combination of amino acid substitutions at two or more positions selected from: 78-X206A/D/F/G/H/M/N/P/R/S/Y, X78A/C/E/F/G/H/I/K/L/M/P/Q/R/T/V/W/Y-206, X78N-X206F/M/Y, X78G-X206D/F/H/M/N/P/R/Y, X78A/C/E/F/H/I/K/L/M/P/Q/R/T/V/W/Y-X206A/D/F/G/H/M/N/P/R/S/Y, 18-X78N, X18K/R-X78N, 18-X87R, X18K/R-X87R, 18-X206L/Y, X18K/R-X206L/Y, 24-X87R, X24F/L/P/R-X87R, 24-X206L/Y, X24F/L/P-206, X24F/L/P-X206Y, X24F/L/P-X209W, 40-78, X40E-78, 40-X78G, X40E-X78G, 40-87, X40E-87, 40-X87R, X40E-X87R, 40-129, 40-X129Q, X40E-129, X40E-X129Q, 40-130, 40-X130A, X40E-130, X40E-X130A, 40-206, X40E-206, 40-X206Y, X40E-X206Y, X78N-87, X78N-X87D/R, X78A/C/E/F/G/H/I/K/L/M/P/Q/R/T/V/W/Y-87, X78G-X87D/R/T, X78A/C/E/F/H/I/K/L/M/P/Q/R/T/V/W/Y-X87R, X78A/C/E/F/G/H/I/K/L/M/P/Q/R/T/V/W/Y-129, X78A/C/E/F/G/H/I/K/L/M/P/Q/R/T/V/W/Y-X129Q, X78A/C/E/F/H/I/K/L/M/P/Q/R/T/V/W/Y-X130A, X78G-X130A/Q, X78A/C/E/F/G/H/I/K/L/M/P/Q/R/T/V/W/Y-130, 78-X249N/R, X78N-249, X78N-X249N/R, 87-X206L/Y, X87D/R-X206L/Y, 87-X209W, X87D/R-X209W, 87-X213A, X87D/R-213, X87D/R-X213A, X87R-X249N/R, 129-X206Y, X129Q-X206Y, 129-X249N/R, X129Q-249, X129Q-X249N/R, 130-X206Y, X130A-X206R/Y, 130-X249N/R, X130A-249, X130A-X249N/R, X206Y-209, X206Y-X209W, 206-X213A, X206L/Y-213, X206L/Y-X213A, X206L/Y-249, X206L/Y-X249N/R, X209W-213, X209W-X213A, X209W-249, X209W-X249N/R, 18-24-78, X18K/R-24-78, 18-X24F/L/P/R-78, 18-24-X78N, X18K/R-24-X78N, 18-X24F/L/P/R-X78N, X18K/R-X24F/L/P/R-78, X18K/R-X24F/L/P/R-X78N, 18-24-87, X18K/R-24-87, 18-X24F/L/P/R-87, 18-24-X87D/R, X18K/R-24-X87D/R, 18-X24F/L/P/R-X87D/R, X18K/R-X24F/L/P/R-87, X18K/R-X24F/L/P/R-X87D/R, 18-24-129, X18K/R-24-129, 18-X24F/L/P/R-129, 18-24-X129Q, X18K/R-X24F/L/P/R-129, X18K/R-24-X129Q, 18-X24F/L/P/R-X129Q, X18K/R-X24F/L/P/R-X129Q, 18-24-130, 18-X24F/L/P/R-130, 18-24-X130A, X18K/R-24-130, X18K/R-X24F/L/P/R-130, X18K/R-24-X130A, 18-X24F/L/P/R-X130A, X18K/R-X24F/L/P/R-X130A, 18-24-206, 18-24-X206L/Y, 18-X24F/L/P/R-206, X18K/R-24-206, X18K/R-24-X206L/Y, 18-X24F/L/P/R-X206L/Y, X18K/R-X24F/L/P/R-206, X18K/R-X24F/L/P/R-X206L/Y, 18-24-209, 18-24-X209W, 18-X24F/L/P/R-209, X18K/R-24-209, X18K/R-24-X209W, 18-X24F/L/P/R-X209W, X18K/R-X24F/L/P/R-209, X18K/R-X24F/L/P/R-X209W, 18-78-87, 18-X78N-87, 18-78-X87D/R, X18K/R-78-87, X18K/R-X78N-87, X18K/R-78-X87D/R, 18-X78N-X87D/R, X18K/R-X78N-X87D/R, 18-78-129, 18-X78N-129, 18-78-X129Q, X18K/R-78-129, X18K/R-X78N-129, X18K/R-78-X129Q, 18-X78N-X129Q, X18K/R-X78N-X129Q, 18-78-130, 18-X78N-130, 18-78-X130A, X18K/R-78-130, X18K/R-X78N-130, X18K/R-78-X130A, 18-X78N-X130A, X18K/R-X78N-X130A, 18-78-206, 18-78-X206L/Y, 18-X78N-206, X18K/R-78-206, 18-X78N-X206L/Y, X18K/R-X78N-206, X18K/R-78-X206L/Y, X18K/R-X78N-X206L/Y, 18-78-209, 18-X78N-209, 18-78-X209W, X18K/R-78-209, X18K/R-78-X209W, 18-X78N-X209W, X18K/R-X78N-209, X18K/R-X78N-X209W, 18-78-213, 18-X78N-213, 18-78-X213A, X18K/R-78-213, 18-X78N-X213A, X18K/R-X78N-213, X18K/R-78-X213A, X18K/R-X78N-X213A, 18-78-249, 18-78-X249N/R, 18-X78N-249, X18K/R-78-249, 18-X78N-X249N/R, X18K/R-X78N-249, X18K/R-78-X249N/R, X18K/R-X78N-X249N/R, 18-87-129, X18K/R-87-129, 18-X87D/R-129, 18-87-X129Q, 18-X87D/R-X129Q, X18K/R-87-X129Q, X18K/R-X87D/R-129, X18K/R-X87D/R-X129Q, 18-87-130, X18K/R-87-130, 18-X87D/R-130, 18-87-X130A, 18-X87D/R-X130A, X18K/R-87-X130A, X18K/R-X87D/R-130, X18K/R-X87D/R-X130A, 18-87-206, X18K/R-87-206, 18-X87D/R-206, 18-87-X206L/Y, 18-X87D/R-X206L/Y, X18K/R-87-X206L/Y, X18K/R-X87D/R-206, X18K/R-X87D/R-X206L/Y, 18-87-209, X18K/R-87-209, 18-X87D/R-209, 18-87-X209W, 18-X87D/R-X209W, X18K/R-X87D/R-209, X18K/R-87-X209W, X18K/R-X87D/R-X209W, 18-X87D/R-213, 18-87-X213A, 18-X87D/R-X213A, X18K/R-X87D/R-213, X18K/R-87-X213A, X18K/R-X87D/R-X213A, 18-87-249, X18K/R-87-249, 18-X87D/R-249, 18-87-X249N/R, 18-X87D/R-X249N/R, X18K/R-X87D/R-249, X18K/R-87-X249N/R, X18K/R-X87D/R-X249N/R, 18-129-130, X18K/R-129-130, 18-X129Q-130, 18-129-X130A, X18K/R-X129Q-130, X18K/R-129-X130A, 18-X129Q-X130A, X18K/R-X129Q-X130A, 18-129-206, X18K/R-129-206, 18-X129Q-206, 18-129-X206L/Y, X18K/R-X129Q-206, X18K/R-129-X206L/Y, 18-X129Q-X206L/Y, X18K/R-X129Q-X206L/Y, 18-129-209, X18K/R-129-209, 18-X129Q-209, 18-129-X209W, X18K/R-X129Q-209, X18K/R-129-X209W, 18-X129Q-X209W, X18K/R-X129Q-X209W, 18-129-213, X18K/R-129-213, 18-X129Q-213, 18-129-X213A, X18K/R-X129Q-213, X18K/R-129-X213A, 18-X129Q-X213A, X18K/R-X129Q-X213A, 18-129-249, X18K/R-129-249, 18-X129Q-249, 18-129-X249N/R, X18K/R-X129Q-249, X18K/R-129-X249N/R, 18-X129Q-X249N/R, X18K/R-X129Q-X249N/R, 18-130-206, X18K/R-130-206, 18-X130A-206, 18-130-X206L/Y, X18K/R-X130A-206, X18K/R-130-X206L/Y, 18-X130A-X206L/Y, X18K/R-X130A-X206L/Y, 18-130-209, X18K/R-130-209, 18-X130A-209, 18-130-X209W, X18K/R-X130A-209, X18K/R-130-X209W, 18-X130A-X209W, X18K/R-X130A-X209W, 18-130-213, X18K/R-130-213, 18-X130A-213, 18-130-X213A, X18K/R-X130A-213, X18K/R-130-X213A, 18-X130A-X213A, X18K/R-X130A-X213A, 18-130-249, X18K/R-130-249, 18-X130A-249, 18-130-X249N/R, X18K/R-X130A-249, X18K/R-130-X249N/R, 18-X130A-X249N/R, X18K/R-X130A-X249N/R, 18-206-209, 18-206-X209W, 18-X206L/Y-209, 18K/R-206-209, 18-X206L/Y-X209W, X18K/R-X206L/Y-209, X18K/R-206-X209W, X18K/R-X206L/Y-X209W, 18-206-213, X18K/R-206-213, 18-206L/Y-213, 18-206-X213A, X18K/R-X206L/Y-213, X18K/R-206-X213A, 18-X206L/Y-X213A, X18K/R-X206L/Y-X213A, 18-206-249, X18K/R-206-249, 18-206L/Y-249, 18-206-X249N/R, X18K/R-X206L/Y-249, X18K/R-206-X249N/R, 18-X206L/Y-X249N/R, X18K/R-X206L/Y-X249N/R, 18-209-213, 18-X209W-213, X18K/R-209-213, 18-209-X213A, 18-X209W-X213A, X18K/R-X209W-213, X18K/R-209-X213A, X18K/R-X209W-X213A, 18-209-249, 18-X209W-249, X18K/R-209-249, 18-209-X249N/R, 18-X209W-X249N/R, X18K/R-X209W-249, X18K/R-209-X249N/R, X18K/R-X209W-X249N/R, 18-213-X249N/R, X18K/R-X213A-249, X18K/R-213-X249N/R, 18-X213A-X249N/R, X18K/R-X213A-X249N/R, 24-78-87, 24-78-X87D/R, 24-X78N-87, X24F/L/P/R-78-87, 24-X78N-X87D/R, X24R/P/F-78-X87D/R, X24F/L/P/R-X78N-87, X24R/P/F-X78N-X87D/R, X24F/L/P-78-129, X24F/L/P-X78N-129, X24F/L/P-78-X129Q, X24F/L/P-X78N-X129Q, X24F/L/P-78-130, X24F/L/P-X78N-130, X24F/L/P-78-X130A, X24F/L/P-X78N-X130A, 24-78-X206Y, X24F/L/P-78-206, 24-X78N-X206Y, X24F/L/P-X78N-206, X24F/L/P-78-X206L/Y, X24F/L/P-X78N-X206L/Y, X24F/L/P-78-209, X24F/L/P-X78N-209, X24F/L/P-78-X209W, X24F/L/P-X78N-X209W, 24-78-213, X24F/L/P/R-78-213, X24F/L/P/R-X78N-213, X24F/L/P-78-X213A, X24F/L/P/R-X78N-X213A, 24-78-X213A, 24-X78N-X213A, X24F/L/P/R-X78N-X213A, 24-78-X249N/R, 24-X78N-249, 24-X78N-X249N/R, X24F/L/P/R-X78N-249, X24F/L/P/R-78-X249N/R, X24F/L/P/R-X78N-X249N/R, 24-87-129, X24F/L/P/R-87-129, 24-X87D/R-129, 24-87-X129Q, X24F/L/P/R-X87D/R-129, X24F/L/P/R-87-X129Q, 24-X87D/R-X129Q, X24F/L/P/R-X87D/R-X129Q, 24-87-130, X24F/L/P/R-87-130, 24-X87D/R-130, 24-87-X130A, X24F/L/P/R-X87D/R-130, X24F/L/P/R-87-X130A, 24-X87D/R-X130A, X24F/L/P/R-X87D/R-X130A, 24-87-X206L/Y, 24-X87R-206, X24F/L/P/R-87-206, 24-X87D/R-X206L/Y, X24F/L/P/R-X87D/R-206, X24F/L/P/R-87-X206L/Y, X24F/L/P/R-X87D/R-X206L/Y, 24-87-X209W, X24F/L/P/R-87-X209W, 24-87-X209W, 24-87D/R-X209W, X24F/L/P/R-X87D/R-X209W, 24-X87D/R-213, 24-87-X213A, 24-X87D/R-X213A, X24F/L/P/R-X87D/R-213, X24F/L/P/R-87-X213A, X24F/L/P/R-X87D/R-X213A, 24-87-249, X24F/L/P/R-87-249, 24-X87D/R-249, 24-87-X249N/R, X24F/L/P/R-X87D/R-249, X24F/L/P/R-87-X249N/R, 24-X87D/R-X249N/R, X24F/L/P/R-X87D/R-X249N/R, X24F/L/P-129-130, X24F/L/P-X129Q-130, X24F/L/P-129-X130A, X24F/L/P-X129Q-X130A, X24F/L/P-129-206, 24-129-X206Y, X24F/L/P-X129Q-206, X24F/L/P-129-X206Y, 24-X129Q-X206Y, X24F/L/P-X129Q-X206L/Y, X24F/L/P/R-X129Q-X206Y, X24F/L/P-129-209, X24F/L/P-X129Q-209, X24F/L/P-129-X209W, X24F/L/P-X129Q-X209W, 24-129-213, X24F/L/P/R-129-213, 24-X129Q-213, 24-129-X213A, X24F/L/P/R-X129Q-213, X24F/L/P-129-X213A, 24-X129Q-X213A, X24F/L/P/R-X129Q-X213A, 24-129-249, X24F/L/P/R-129-249, 24-X129Q-249, 24-129-X249N/R, X24F/L/P/R-X129Q-249, X24F/L/P/R-129-X249N/R, 24-X129Q-X249N/R, X24F/L/P/R-X129Q-X249N/R, X24F/L/P-130-206, 24-130-X206Y, X24F/L/P-X130A-206, X24F/L/P-130-X206L/Y, X24F/L/P-130-X206Y, 24-X130A-X206Y, X24F/L/P-X130A-X206L/Y, X24F/L/P/R-X130A-X206Y, X24F/L/P-130-209, X24F/L/P-X130A-209, X24F/L/P-130-X209W, X24F/L/P-X130A-X209W, 24-130-213, X24F/L/P/R-130-213, 24-X130A-213, 24-130-X213A, X24F/L/P/R-X130A-213, X24F/L/P/R-130-X213A, 24-X130A-X213A, X24F/L/P/R-X130A-X213A, 24-130-249, X24F/L/P/R-130-249, 24-X130A-249, 24-130-X249N/R, X24F/L/P/R-X130A-249, X24F/L/P/R-130-X249N/R, 24-X130A-X249N/R, X24F/L/P/R-X130A-X249N/R, 24-X206Y-209, 24F/L/P-206-209, 24-X206Y-X209W, X24F/L/P-X206L/Y-209, X24F/L/P/R-X206Y-209, X24F/L/P-206-X209W, X24F/L/P-X206L/Y-X209W, X24F/L/P/R-X206Y-X209W, 24-206-213, X24F/L/P/R-206-213, 24-X206L/Y-213, 24-206-X213A, X24F/L/P/R-X206L/Y-213, X24F/L/P/R-206-X213A, 24-X206L/Y-X213A, X24F/L/P/R-X206L/Y-X213A, 24-206-249, 24-X206L/Y-249, X24F/L/P/R-206-249, 24-206-X249N/R, X24F/L/P/R-X206L/Y-X249N/R, X24F/L/P/R-X206L/Y-249, X24F/L/P-206-X249N/R, X24F/L/P/R-X206L/Y-X249N/R, 24-209-213, 24-X209W-213, X24F/L/P/R-209-213, 24-209-X213A, X24F/L/P/R-X209W-213, 24-209-X213A, X24F/L/P/R-209-X213A, X24F/L/P/R-X209W-X213A, 24-209-249, 24-X209W-249, X24F/L/P/R-209-249, 24-209-X249N/R, X24F/L/P/R-X209W-249, 24-X209W-X249N/R, X24F/L/P/R-209-X249N/R, X24F/L/P/R-X209W-X249N/R, 78-87-129, X78N-87-129, 78-X87D/R-129, 78-87-X129Q, X78N-X87D/R-129, X78N-87-X129Q, 78-X87D/R-X129Q, X78N-X87D/R-X129Q, 78-87-130, X78N-87-130, 78-X87D/R-130, 78-87-X130A, X78N-X87D/R-130, X78N-87-X130A, 78-X87D/R-X130A, X78N-X87D/R-X130A, 78-87-206, 78-87-X206L/R/Y, X78N-87-206, 78-X87D/R-206, 78-X87D/R-X206L/R/Y, X78N-87-X206L/R/Y, X78N-X87D/R-206, X78N-X87D/R-X206L/R/Y, 78-87-209, 78-87-X209W, X78N-87-209, 78-X87D/R-209, X78N-X87D/R-209, 78-X87D/R-X209W, X78N-87-X209W, X78N-X87D/R-X209W, 78-87-213, X78N-87-213, 78-X87D/R-213, 78-87-X213A, X78N-X87D/R-213, X78N-87-X213A, 78-X87D/R-X213A, X78N-X87D/R-X213A, 78-87-249, 78-87-X249N/R, X78N-87-249, 78-X87D/R-249, X78N-X87D/R-249, 78-X87D/R-X249N/R, X78N-87-X249N/R, X78N-X87D/R-X249N/R, 78-129-X206R/Y, X78N-129-X206Y, 78-X129Q-X206R/Y, X78N-X129Q-X206Y, 78-129-213, X78N-129-213, 78-X129Q-213, 78-129-X213A, X78N-X129Q-213, X78N-129-X213A, 78-X129Q-X213A, X78N-X129Q-X213A, 78-129-249, X78N-129-249, 78-X129Q-249, 78-129-X249N/R, X78N-X129Q-249, X78N-129-X249N/R, 78-X129Q-X249N/R, X78N-X129Q-X249N/R, 78-130-X206R/Y, X78N-130-X206Y, 78-X130A-X206R/Y, X78N-X130A-X206Y, 78-130-213, X78N-130-213, 78-X130A-213, 78-130-X213A, X78N-X130A-213, X78N-130-X213A, 78-X130A-X213A, X78N-X130A-X213A, 78-130-213, X78N-130-213, 78-X130A-213, 78-130-X213A, X78N-X130A-213, X78N-130-X213A, 78-X130A-X213A, X78N-X130A-X213A, 78-130-249, X78N-130-249, 78-X130A-249, 78-130-X249N/R, X78N-X130A-249, X78N-130-X249N/R, 78-X130A-X249N/R, X78N-X130A-X249N/R, 78-206-209, X78N-206-209, 78-X206L/Y-209, 78-206-X209W, X78N-X206L/Y-209, X78N-206-X209W, 78-X206L/Y-X209W, X78N-X206L/Y-X209W, 78-206-213, X78N-206-213, 78-X206L/Y-213, 78-206-X213A, X78N-X206L/Y-213, X78N-206-X213A, 78-X206L/Y-X213A, X78N-X206L/Y-X213A, 78-206-249, 78-206-X249R/N, 78-X206L/Y-249, X78N-206-249, X78N-206-X249N/R, 78-X206L/Y-X249N/R, X78N-X206L/Y-249, X78N-X206L/Y-X249N/R, 78-209-213, 78-X209W-213, 78-209-X213A, X78N-209-213, X78N-X209W-213, X78N-209-X213A, 78-X209W-X213A, X78N-X209W-X213A, 78-209-249, 78-X209W-249, 78-209-X249N/R, X78N-209-249, 78-X209W-X249N/R, X78N-X209W-249, X78N-209-X249N/R, X78N-X209W-X249N/R, 78-213-249, 78-X213A-249, X78N-213-249, 78-213-X249N/R, X78N-X213A-249, X78N-213-X249N/R, 78-X213A-X249N/R, X78N-X213A-X249N/R, 87-129-130, X87D/R-129-130, 87-X129Q-130, 87-129-X130A, X87D/R-X129Q-130, X87D/R-129-X130A, 87-X129Q-X130A, X87D/R-X129Q-X130A, 87-129-206, X87D/R-129-206, 87-X129Q-206, 87-129-X206L/R/Y, X87D/R-X129Q-206, X87D/R-129-X206L/R/Y, 87-X129Q-X206L/R/Y, X87D/R-X129Q-X206L/R/Y, 87-129-209, X87D/R-129-209, 87-X129Q-209, 87-129-X209W, X87D/R-X129Q-209, X87D/R-129-X209W, 87-X129Q-X209W, X87D/R-X129Q-X209W, 87-129-213, X87D/R-129-213, 87-X129Q-213, 87-129-X213A, X87D/R-X129Q-213, X87D/R-129-X213A, 87-X129Q-X213A, X87D/R-X129Q-X213A, 87-129-249, X87D/R-129-249, 87-X129Q-249, 87-129-X249N/R, X87D/R-X129Q-249, X87D/R-129-X249N/R, 87-X129Q-X249N/R, X87D/R-X129Q-X249N/R, 87-130-206, X87D/R-130-206, 87-X130A-206, 87-130-X206L/R/Y, X87D/R-X130A-206, X87D/R-130-X206L/R/Y, 87-X130A-X206L/R/Y, X87D/R-X130A-X206L/R/Y, 87-130-209, X87D/R-130-209, 87-X130A-209, 87-130-X209W, X87D/R-X130A-209, X87D/R-130-X209W, 87-X130A-X209W, X87D/R-X130A-X209W, 87-130-213, X87D/R-130-213, 87-X130A-213, 87-130-X213A, X87D/R-X130A-213, X87D/R-130-X213A, 87-X130A-X213A, X87D/R-X130A-X213A, 87-130-249, X87D/R-130-249, 87-X130A-249, 87-130-X249N/R, X87D/R-X130A-249, X87D/R-130-X249N/R, 87-X130A-X249N/R, X87D/R-X130A-X249N/R, 87-206-209, X87D/R-206-209, 87-X206L/Y-209, 87-206-X209W, X87D/R-X206L/Y-209, X87D/R-206-X209W, 87-X206L/Y-X209W, X87D/R-X206L/Y-X209W, 87-206-213, 87-X206L/Y-213, 87-206-X213A, X87D/R-206-213, X87D/R-X206L/Y-213, X87D/R-206-X213A, 87-X206L/Y-X213A, X87D/R-X206L/Y-X213A, 87-206-249, X87-X206L/Y-249, 87D/R-206-249, 87-209-X249N/R, X87R-206-X249N/R, X87D/R-X206L/Y-249, 87-X206L/Y-X249N/R, X87R-X206L/Y-X249N/R, 87-209-213, X87D/R-209-213, 87-X209W-213, 87-209-X213A, X87D/R-X209W-213, X87D/R-209-X213A, 87-X209W-X213A, X87D/R-X209W-X213A, 87-209-249, 87-X209W-249, 87-209-X249N/R, X87D/R-209-249, X87D/R-X209W-249, 87-X209W-X249N/R, X87R-209-X249N/R, X87D/R-X209W-X249N/R, 87-213-249, 87-X213A-249, X87D/R-213-249, 87-213-X249N/R, X87D/R-X213A-249, X87D/R-213-X249N/R, 87-X213A-X249N/R, X87D/R-X213A-X249N/R, 129-130-X206R/Y, X129Q-130-X206R/Y, 129-X130A-X206R/Y, X129Q-X130A-X206R/Y, 129-130-213, X129Q-130-213, 129-X130A-213, 129-130-X213A, X129Q-X130A-213, X129Q-130-X213A, 129-X130A-X213A, X129Q-X130A-X213A, 129-130-249, X129Q-130-249, 129-X130A-249, 129-130-X249N/R, X129Q-X130A-249, X129Q-130-X249N/R, 129-X130A-X249N/R, X129Q-X130A-X249N/R, 129-X206Y-209, X129Q-X206Y-209, 129-X206Y-X209W, X129Q-X206Y-X209W, 129-206-213, 129-X206L/Y-213, 129-206-X213A, X129Q-206-213, X129Q-X206L/Y-213, X129Q-206-X213A, 129-X206L/Y-X213A, X129Q-X206L/Y-X213A, 129-206-249, 129-X206L/Y-249, 129-206-X249N/R, X129Q-206-249, X129A-X206L/Y-249, X129Q-206-X249N/R, 129-X206L/Y-X249N/R, X129Q-X206L/Y-X249N/R, 129-209-213, 129-X209W-213, 129-209-X213A, X129Q-209-213, X129Q-X209W-213, X129Q-209-X213A, 129-X209W-X213A, X129Q-X209W-X213A, 129-209-249, 129-X209W-249, 129-209-X249N/R, X129Q-209-249, X129Q-X209W-249, X129Q-209-X249N/R, 129-X209W-X249N/R, X129Q-X209W-X249N/R, 129-213-249, 129-X213A-249, 129-213-X249N/R, X129Q-213-249, X129Q-X213A-249, 129-X213A-X249R, X129Q-213-X249N/R, X129Q-X213A-X249N/R, 130-X206Y-209, X130A-X206Y-209, 130-X206Y-X209W, X130A-X206Y-X209W, 130-206-213, 130-X206L/Y-213, 130-206-X213A, X130A-206-213, X130A-X206L/Y-213, X130A-206-X213A, 130-X206L/Y-X213A, X130A-X206L/Y-X213A, 130-206-249, 130-X206L/Y-249, 130-206-X249N/R, X130A-206-249, X130A-X206L/Y-249, X130A-206-X249N/R, 130-X206L/Y-X249N/R, X130A-X206L/Y-X249N/R, 130-209-213, 130-X209W-213, 130-209-X213A, X130A-209-213, X130A-X209W-213, X130A-209-X213A, 130-X209W-X213A, X130A-X209W-X213A, 130-209-249, 130-X209W-249, 130-209-X249N/R, X130A-209-249, X130A-X209W-249, X130A-209-X249N/R, 130-X209W-X249N/R, X130A-X209W-X249N/R, 130-213-249, 130-X213A-249, 130-213-X249N/R, X130A-213-249, X130A-X213A-249, 130-X213A-X249R, X130A-213-X249N/R, X130A-X213A-X249N/R, 130-209-249, 130-X209W-249, 130-209-X249N/R, X130A-209-249, X130A-X209W-249, X130A-209-X249N/R, 130-X209W-X249N/R, X130A-X209W-X249N/R, 206-209-213, 206-X209W-213, 206-209-X213A, X206L/Y-209-213, 206-X209W-X213A, X206L/Y-X209W-213, X206L/Y-209-X213A, X206L/Y-X209W-X213A, 206-209-249, 206-X209W-249, 206-209-X249N/R, X206L/Y-209-249, X206L/Y-X209W-249, 206-X209W-X249N/R, X206L/Y-209-X249N/R, X206L/Y-X209W-X249N/R, 206-213-249, 206-X213A-249, 206-213-X249N/R X206L/Y-213-249, X206L/Y-X213A-249, X206L/Y-213-X249N/R, 206-X213A-X249N/R, X206L/Y-X213A-X249N/R, 209-213-249, X209W-213-249, 209-X213A-249, 209-213-X249N/R, X209W-X213A-249, X209W-213-X249N/R, 209-X213A-X249N/R, X209W-X213A-X249N/R, and combinations thereof, wherein X is any amino acid and said variant has proteolytic activity; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence.

Another embodiment provides an isolated subtilisin variant comprising an amino acid sequence comprising two or more substitutions selected from: (i) 3-8, 3-40, 3-78, 3-87, 3-118, 3-128, 3-129, 3-130, 3-210, 3-211, 3-215, 3-217, 3-261, 3-262, 8-40, 8-76, 8-87, 8-118, 8-128, 8-210, 8-215, 8-261, 18-78, 18-87, 18-118, 18-206, 24-87, 24-206, 24-209, 24-213, 24-222, 40-76, 40-87, 40-118, 40-128, 40-210, 40-215, 40-217, 40-261, 76-210, 76-211, 76-213, 76-215, 76-217, 76-249, 76-261, 76-262, 78-87, 78-118, 78-210, 78-213, 78-222, 78-249, 87-206, 87-209, 87-213, 87-215, 87-217, 87-222, 87-249, 87-261, 118-206, 118-209, 118-210, 118-211, 118-213, 118-215, 118-217, 118-222, 118-249, 118-261, 118-262, 128-209, 128-210, 128-215, 128-217, 128-261, 129-206, 129-209, 130-206, 130-209, 206-213, 206-249, 209-213, 209-249, 210-217, 210-261, 213-222, 213-249, 215-261, 222-249, and combinations thereof, (ii) 3-76-118, 18-24-206, 18-24-209, 18-24-213, 18-24-249, 18-87-209, 18-118-209, 18-206-209, 18-209-213, 18-209-222, 18-209-249, 18-213-249, 24-76-78, 24-76-87, 24-76-118, 24-76-209, 24-76-222, 24-76-249, 24-78-87, 24-78-118, 24-78-206, 24-78-209, 24-78-222, 24-78-249, 24-87-118, 24-87-209, 24-87-222, 24-87-249, 24-118-209, 24-118-222, 24-118-249, 24-206-209, 24-206-249, 24-209-213, 24-209-222, 24-209-249, 24-213-249, 24-222-249, 76-78-118, 76-78-87, 76-78-129, 76-78-130, 76-78-206, 76-78-209, 76-78-222, 76-78-249, 76-87-118, 76-87-206, 76-87-209, 76-87-249, 76-118-128, 76-118-206, 76-118-209, 76-118-222, 76-118-249, 76-209-222, 76-209-249, 78-87-118, 78-87-129, 78-87-130, 78-87-206, 78-87-209, 78-87-222, 78-87-249, 78-118-129, 78-118-209, 78-118-222, 78-118-249, 78-129-130, 78-209-222, 78-209-249, 78-222-249, 87-118-206, 87-118-209, 87-118-249, 87-206-209, 87-209-222, 87-209-249, 87-222-249, 118-209-213, 118-209-222, 118-209-249, 118-222-249, 206-209-249, 209-213-222, 209-213-249, 209-222-249, and combinations thereof, (iii) X3V-X8V, X3V-X40E, X3V-X78G/N, X3V-X87D, X3V-X118R, X3V-X128R, X3V-X129Q, X3V-X130A, X3V-X210I, X3V-X211P, X3V-X215K, X3V-X217K, X3V-X261I, X3V-X262Q, X8V-X40E, X8V-X76D, X8V-X87D, X8V-X118R, X8V-X128R, X8V-X210I, X8V-X215K, X8V-X261I, X18R-X78N, X18R-X87R, X18R-X118R, X18R-X206L, X24R-S78N, X24R-X87D/R, X24R-X206L/Y, X24R-X209W, X24R-X213A, X24R-X222Q, X40E-X76D, X40E-X87D/R, X40E-X118R, X40E-X128R, X40E-X210I, X40E-X215K, X40E-X217K, X40E-X261I, X76D-X87D, X76D-X128R, X76D-X206F/R/M/Y, X76D-X210I, X76D-X211P, X76D-X213A, X76D-X215K, X76D-X217K, X76D-X249R, X76D-X261I, X76D-X262Q, X78G-X206F/L/M/Y, X78G-X210I, X78G-X261I, X78G/N-X87D/R, X78G/N-X118R, X78G/N-X128L, X78G/N-X129Q, X78G/N-X130A, X78N-X213A, X78N-X222Q, X78N-X249R, X87D-X118R, X87D-X128L/R, X87D-X129Q, X87D-X130A, X87D/R-X209W, X87D-X210I, X87D-X215K, X87D-X217K, X87D/R-X222Q, X87D/R-X249R, X87R-X206F/L/M/R/Y, X87D-X213A, X87D/R-X261I, X118R-X128R, X118R-X206F/M/L/R/Y, X118R-X209W, X118R-X210II, X118R-X211P, X118R-X213A, X118R-X215K, X118R-X217K, X118R-X222Q, X118R-X249R, X118R-X261I, X118R-X262Q, X128L-X206F/L/M/R/Y, X128L-X209W, X128R-P210I, X128R-A215K, X128R-L217K, X128R-N261I, X129Q-X206F/L/M/R/Y, X129Q-X209W, X130A-X206F/L/M/R/Y, S130A-Y209W, X206L/Y-X213A, X206L/Y-X222Q, X206L/Y-X249R, X209W-X213A, X209W-X222Q, X209W-X249R, X210I-X217K, X210I-X261I, X213A-X222Q, X213A-X249R, X215K-X261I, X222Q-X249R, and combinations thereof, (iv) X3V-X76D-X118R, X18R-X24R-X206L/Y, X18R-X24R-X209W, X18R-X24R-X213A, X18R-X24R-X249R, X18R-X87D/R-X209W, X18R-X118R-X209W, X18R-X206L/Y-X209W, X18R-X206L/Y-X249R, X18R-X209W-X213A, X18R-X209W-X222Q, X18R-X209W-X249R, X18R-X213A-X249R, X24R-X76D-X78G/N, X24R-X76D-X87D/R, X24R-X76D-X118R, X24R-X76D-X209W, X24R-X76D-X222Q, X24R-X76D-X249R, X24R-X78G/N-X87D/R, X24R-X78G/N-X118R, X24R-X78G/N-X206L/Y, X24R-X78G/N-X209W, X24R-X78G/N-X222Q, X24R-X78G/N-X249R, X24R-X87D/R-X118R, X24R-X87D/R-X209W, X24R-X87D/R-X222Q, X24R-X87D/R-X249R, X24R-X118R-X209W, X24R-X118R-X222Q, X24R-X118R-X249R, X24R-X206L-X209W, X24R-X206L/Y-X249R, X24R-X209W-X213A, X24R-X209W-X222Q, X24R-X209W-X249R, X24R-X213A-X249R, X24R-X222Q-X249R, X76D-X78G/N-X87D/R, X76D-X78G/N-X118R, X76D-X78G/N-X129Q, X76D-X78G/N-X130A, X76D-X78G/N-X206L, X76D-X78G/N-X209W, X76D-X78G/N-X222Q, X76D-X78G/N-X249R, X76D-X87D/R-X118R, X76D-X87D-X206L/Y, X76D-X87D/R-X209W, X76D-X87D/R-X249R, X76D-X118R-X128R, X76D-X118R-X206L/Y, X76D-X118R-X209W, X76D-X118R-X222Q, X76D-X118R-X249R, X76D-X209W-X222Q, X76D-X209W-X249R, X78G/N-X87D/R-X118R, X78G/N-X87D/R-X129Q, X78G/N-X87D/R-X130A, X78G/N-X87D/R-X206L/Y, X78G/N-X87D/R-X209W, X78G/N-X87D/R-X222Q, X78G/N-X87D/R-X249R, X78G/N-X118R-X129Q, X78G/N-X118R-X209W, X78G/N-X118R-X222Q, X78G/N-X118R-X249R, X78G/N-X129Q-X130A, X78G/N-X209W-X222Q, X78G/N-X209W-X249R, X78G/N-X222Q-X249R, X87D/R-X118R-X206L, X87D/R-X118R-X209W, X87D/R-X118R-X249R, X87D/R-X206L/Y-X209W, X87D/R-X209W-X222Q, X87D/R-X209W-X249R, X87D/R-X222Q-X249R, X118R-X209W-X213A, X118R-X209W-X222Q, X118R-X209W-X249R, X118R-X222Q-X249R, X206L-X209W-X249R, X209W-X213A-X222Q, X209W-X213A-X249R, X209W-X222Q-X249R, and combinations thereof, (v) S3V-18V, S3V-P40E, S3V-S78G/N, S3V-S87D, S3V-G118R, S3V-S128R, S3V-P129Q, S3V-S130A, S3V-P210I, S3V-G211P, S3V-A215K, S3V-L217K, S3V-N261I, S3V-L262Q, 18V-P40E, 18V-N76D, 18V-S87D, 18V-G118R, 18V-S128R, I8V-P210I, I8V-A215K, I8V-N261I, N18R-S78N, N18R-S87R, N18R-G118R, N18R-Q206L, S24R-S78N, S24R-S87D/R, S24R-Q206L/Y, S24R-Y209W, S24R-T213A, S24R-M222Q, P40E-N76D, P40E-S87D/R, P40E-G118R, P40E-S128R, P40E-P210I, P40E-A215K, P40E-L217K, P40E-N261I, N76D-S87D, N76D-P210I, N76D-S128R, N76D-Q206F/R/M/Y, N76D-P210I, N76D-G211P, N76D-T213A, N76D-A215K, N76D-L217K, N76D-H249R, N76D-N261I, N76D-L262Q, S78G-Q206F/L/M/Y, S78G-P210I, S78G-N261I, S78G/N-S87D/R, S78G/N-G118R, S78G/N-S128L, S78G/N-P129Q, S78G/N-S130A, S78N-T213A, S78N-M222Q, S78N-H249R, S87D-G118R, S87D-S128L/R, S87D-P129Q, S87D-S130A, S87D/R-Y209W, S87D-P210I, S87D-A215K, S87D-L217K, S87D/R-M222Q, S87D/R-H249R, S87R-Q206F/L/M/R/Y, S87R-T213A, S87D/R-N261I, G118R-S128R, G118R-Q206L/R/Y, G118R-Y209W, G118R-P210I, G118R-G211P, G118R-T213A, G118R-L217K, G118R-M222Q, G118R-H249R, G118R-N261I, G118R-L262Q, S128L-Q206F/L/M/R/Y, S128L-Y209W, S128R-P210I, S128R-A215K, S128R-L217K, S128R-N261I, P129Q-

Q206F/L/M/R/Y, P129Q-Y209W, S130A-Q206F/L/M/R/Y, S130A-Y209W, Q206L/Y-T213A, Q206L/Y-M222Q, Q206L/Y-H249R, Y209W-T213A, Y209W-M222Q, Y209W-H249R, P210I-L217K, P210I-N261I, T213A-M222Q, T213A-H249R, A215K-N261I, M222Q-H249R, and combinations thereof, or (vi) S3V-N76D-G118R, N18R-S24R-Q206L/Y, N18R-S24R-Y209W, N18R-S24R-T213A, N18R-S24R-H249R, N18R-S87D/R-Y209W, N18R-G118R-Y209W, N18R-Q206L/Y-Y209W, N18R-Q206L/Y-H249R, N18R-Y209W-T213A, N18R-Y209W-M222Q, N18R-Y209W-H249R, N18R-T213A-H249R, S24R-N76D-S78G/N, S24R-N76D-S87D/R, S24R-N76D-G118R, S24R-N76D-Y209W, S24R-N76D-M222Q, S24R-N76D-H249R, S24R-S78G/N-S87D/R, S24R-S78G/N-G118R, S24R-S78G/N-Q206L, Y209W S24R-S78G/N-Y209W, S24R-S78G/N-M222Q, S24R-S78G/N-H249R, S24R-S87D/R-G118R, S24R-S87D/R-Y209W, S24R-S87D/R-M222Q, S24R-S87D/R-H249R, S24R-G118R-Y209W, S24R-G118R-M222Q, S24R-G118R-H249R, S24R-Q206L/Y-Y209W, S24R-Q206L/Y-H249R, S24R-Y209W-T213A, S24R-Y209W-M222Q, S24R-Y209W-H249R, S24R-T213A-H249R, S24R-M222Q-H249R, N76D-S78G/N-S87D/R, N76D-S78G/N-G118R, N76D-S78G/N-P129Q, N76D-S78G/N-S130A, N76D-S78G/N-Q206L, N76D-S78G/N-Y209W, N76D-S78G/N-M222Q, N76D-S78G/N-H249R, N76D-S87D/R-G118R, N76D-S87D/R-Q206L/Y, N76D-S87D/R-Y209W, N76D-S87D/R-H249R, N76D-G118R-S128R, N76D-G118R-Q206L/Y, N76D-G118R-Y209W, N76D-G118R-M222Q, N76D-G118R-H249R, N76D-Y209W-M222Q, N76D-Y209W-H249R, S78G/N-S87D/R-G118R, S78G/N-S87D/R-P129Q, S78G/N-S87D/R-S130A, S78G/N-S87D/R-Q206L/Y, S78G/N-S87D/R-Y209W, S78G/N-S87D/R-M222Q, S78G/N-S87D/R-H249R, S78G/N-G118R-P129Q, S78G/N-G118R-Y209W, S78G/N-G118R-M222Q, S78G/N-G118R-H249R, S78G/N-P129Q-S130A, S78G/N-Y209W-M222Q, S78G/N-Y209W-H249R, S78G/N-M222Q-H249R, S87D/R-G118R-Q206L, S87D/R-G118R-Y209W, S87D/R-G118R-H249R, S87D/R-Q206L/Y-Y209W, S87D/R-Y209W-H249R, S87D/R-Y209W-M222Q, S87D/R-M222Q-H249R, G118R-Y209W-T213A, G118R-Y209W-M222Q, G118R-Y209W-H249R, G118R-M222Q-H249R, Q206L/Y-Y209W-H249R, Y209W-T213A-M222Q, Y209W-T213A-H249R, Y209W-M222Q-H249R, and combinations thereof, and wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence.

Still another embodiment is directed to an isolated subtilisin variant comprising an amino acid sequence comprising a substitution at one, two, three, four, five or six positions selected from: 76, 87, 118, 128, 129, and 130; X76D, X87D/R/T, X118A/R/V, X128K/L/R, X129Q/R, and X130A/Q; or N76D, S87D/R/T, G118A/R/V, S128K/L/R, P129Q/R and S130A/Q in combination with one or more substitutions at one or more positions selected from: (i) 1, 3, 8, 9, 16, 18, 20, 22, 24, 28, 40, 42, 43, 44, 56, 77, 78, 82, 88, 89, 99, 100, 101, 103, 104, 108, 116, 120, 124, 127, 147, 150, 158, 159, 160, 166, 185, 188, 194, 204, 206, 209, 210, 211, 212, 213, 215, 216, 217, 218, 222, 232, 235, 241, 243, 245, 246, 248, 249, 251, 252, 254, 256, 259, 261, 262, 268, 270, and 271; (ii) X1V, X3I/T/V, X8V, X9G, X16T, X18K/R, X20E/R, X22L/W, X24F/L/P/R, X28T, X40E, X42I, X43R/S/Y, X44V, X56P, X77D, X78A/C/E/F/G/H/I/K/L/M/N/P/Q/R/T/V/W/Y, X82D, X88S, X89H, X99N, X100S, X101F/G/H/Q/T/V, X103A/D/P, X104I, X108S, X116L/M, X120R, X124M, X127S/T, X147I, X150T, X158E/T/V, X159D, X160Q, X166D/N, X185Y, X188D, X194D/P, X204D, X206A/D/F/G/H/L/M/N/P/R/S/Y, X209W, X210I, X211P, X212D, X213A, X215K/V, X216Y, X217K, X218S, X222L/Q/S, X232V, X235T, X241K, X243S, X245R, X246V, X248D, X249N/R, X251R, X252I, X254T, X256P, X259G, X261I, X262Q, X268A, X270P/T, and X271D; or (iii) A1V, S3I/T/V, 18V, S9G, A16T, N18K/R, G20E/R, T22L/W, S24F/L/P/R, V28T, P40E, L42I, N43R/S, I44V, S56P, N77D, S78A/C/E/F/G/H/I/K/L/M/N/P/Q/R/T/V/W/Y, L82D, A88S, E89H, S99N, G100S, S101F/G/H/Q/T/V, S103A/D/P, V104I, A108S, N116L/M, H120R, L124M, G127S/T, V147I, V150T, A158E/T/V, G159D, S160Q, S166D/N, N185Y, S188D, A194D/P, N204D, Q206A/D/F/G/H/L/M/N/P/R/S/Y, Y209W, P210I, G211P, S212D, T213A, A215K/V, S216Y, L217K, N218S, M222L/Q/S, A232V, K235T, W241K, N243S, Q245R, I246V, N248D, H249N/R, K251R, N252I, A254T, S256P, S259G, N261I, L262Q, V268A, A270P/T, and E271D; wherein X is any amino acid and said variant has proteolytic activity; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence.

A still further embodiment is directed to an isolated subtilisin variant comprising an amino acid sequence comprising a substitution at two or more positions selected from: S3V-S78N, N18R-G20R, N18R-S24R, N18R-N43R, N18R-R45T, N18R-H249R, G20R-N43R, G20R-R45T, G20R-H249R, T22L-S24F, T22L-S78N, T22L-S166D, T22L-T213A, S24R/F-S78N, S24R-N43R, S24R-Y209W, S24F-S166D, S24R/F-T213A, S24R-H249R, S24R-M222Q, N43R-Y209W, N43R-H249R, N43R-R45T, R45T-H249R, S78G/N-Q206Y/F, S78N-S166D, S78N-T213A, S101A-S188D, S101A-P210I, S101A-A232V, S103A-S188D, S103A-P210I, S103A-A232V, V104I-S188D, V104I-P210I, V104I-A232V, S166D-T213A, S188D-P210I, S188D-A232V, S188D-Q245R, P210I-A232V, A232V-Q245R, Q206Y-T213A, Q206L/Y-M222Q, Q206L-H249R, M222Q-H249R, Y209W-M222Q, T213A-H249R, Y209W-H249R, and combinations thereof, wherein said substitution at two or more positions is further combined with one or more substitutions selected from 76, 87, 118, 128, 129, and 130; X76D, X87R, X118R, X128L, X129Q, and X130A; or N76D, S87R, GI18R, S128L, P129Q and S130A; wherein X is any amino acid and said variant has proteolytic activity; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence.

An even further embodiment is directed to an isolated subtilisin variant comprising an amino acid sequence comprising two or more substitutions selected from S3V-N76D, S24R-N76D, S24R-G118R, S24R-H249R, N76D-S78G, N76D-S78N, N76D-Q206L, N76D-Y209W, N76D-M222Q, S78N-Q206L, S78N-Y209W, N76D-S78N-Y209W, N76D-S78N-Q206L, N76D-Q206L-Y209W, and combinations thereof, wherein said substitutions at two or more positions is further combined with one or more substitutions selected from: (i) A1V, S3I/T/V, 18V, S9G, A16T, N18K/R, G20E/R, T22L/W, S24F/L/P/R, V28T, P40E, L42I, N43R/S, I44V, S56P, N77D, S78A/C/E/F/G/H/I/K/L/M/N/P/Q/R/T/V/W/Y, L82D, A88S, E89H, S99N, G100S, S101F/G/H/Q/T/V, S103A/D/P, V104I, A108S, N116L/M, H120R, L124M, G127S/T, V147I, V150T, A158E/T/V, G159D, S160Q, S166D/N, N185Y, S188D, A194D/P, N204D, Q206A/D/F/G/H/L/M/N/P/R/S/Y, Y209W, P210I, G211P, S212D, T213A, A215K/V, S216Y, L217K, N218S, M222L/Q/S, A232V, K235T, W241K, N243S, Q245R, I246V, N248D, H249N/R, K251R, N252I, A254T, S256P, S259G, N261I, L262Q, V268A, A270P/T, and E271D; (ii) S3T/V, I8V, N18R, T22W, S24R, V28T, P40E, N43S, S78A/C/E/F/G/H/I/K/L/M/N/P/Q/R/T/V/W/Y, E89H, S99N, S101F/G/V, S103A/D/P, V104I, A108S, N116M, L124M, G127T, V147I, V150T, A158E/T, G159D, S166D, S188D, A194D/P, Q206A/D/F/G/H/L/M/N/P/R/S/Y, Y209W, P210I/L, G211P, S212D, T213A, A215V, L217K, M222Q/S, A232V, K235T, N243S, Q245R, I246V, H249N/R, N261I, L262Q, A270T, and E271D; (iii) S3V, I8V, S24R, P40E, N76D, S78G/N, S87D/R, G118R, S128L/R, P129Q, S130A, Q206F/L/M/Y, Y209W, P210I, T213A, A215K, L217K, M222Q, H249R, and N261I; (iv) I8V, P40E, S87D/R, S128L/R, P129Q, S130A, P210I, T213A, A215K, L217K, and N261I; (v) S3V, N18R, S24R, P40E, S78G/N, G127T, S166D/N, Q206L/R/Y, Y209W, P210I, G211P, T213A, L217K, M222Q/S, H249N/R, N261I, and L262Q; or (vi) S3V, N18R, S24R, S78G/N, Q206L/R/Y, and H249N/R; wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence.

A yet even further embodiment is directed to an isolated subtilisin variant comprising a combination of amino acid substitutions selected from: N18R-S87R-G118R-S166N-N204D-Q206L-Y209W; N18R-S24R-L42I-G118R-Y209W-T213A-M222Q-H249R; N18R-S24R-Y209W-T213A-H249R; N18R-S24R-S87R-G118R-S128L-P129Q-S130A-Q206Y-Y209W-T213A-H249R; S24R-S87D-G118R-Y209W-T213A-H249R; S9G-N18R-S24R-N76D-G118R-S166N-Q206L-H249R; N18R-G118R-Q206L-Y209W-T213A-M222Q-H249R; S24R-S87R-S166N; N18R-S24R-S87R-Q206L-Y209W-T213A; N18R-S24R-G118R-A158V-Y209W; N18R-S24R-S87D-Q206L-Y209W-M222Q-H249R; N18R-S24R-S87R-G127T; S24R-S166N-Y209W-T213A; N76D-S78N-G118R-Y209W-H249R; N18R-N76D-S78N-S87R-Q206L-Y209W-H249R-S259G; N18R-S24R-S87D-N185Y-Q206L-Y209W-T213A-M222Q-H249R; S24R-G118R-G127T-Y209W; A1V-N18R-S24R-S56P-G127T-Q206L-Y209W; S87R-Y209W; N18R-S87D-Y209W-M222Q-H249R; N18R-S24R-G118R-S128L-P129Q-S130A-S166D-Y209W-T213A; S87D-S166D-T213A-H249R; N18R-S24P-S87D-S166N-Q206L-Y209W-M222Q-H249R; N76D-S166N-Y209W-T213A-H249R; S24R-Q206L-Y209W-T213A-M222Q-H249R; N18R-G118R-Q206L-Y209W; N18R-S24R-S166D-Q206Y-H249R-A254T; N18R-S24R-S78N-Q206L-Y209W-T213A-M222Q-H249R; N18R-S24R-G118R-G127T-Y209W; S24R-N76D-G118R-S166N-Q206L-Y209W; S24R-N76D-S87R-Y209W-T213A-M222Q-H249R; N18K-S87R-Y209W-T213A-M222Q-H249R; N18R-S24R-S87R-Y209W; N18R-S78N-G118R-Y209W-T213A-M222Q-H249R-A270P; N18R-S166N-Y209W-T213A-M222Q; N76D-S78N-S87R-S103P-G118R-S128L-P129Q-S130A-Q206L; N76D-S78N-S87R-G118R-S128L-P129Q-S130A-Q206L-N243S; N76D-S78N-S87R-G118R-S128L-P129Q-S130A-Q206L-H249R; N18R-N76D-S78N-S87R-G118R-S128L-P129Q-S130A-Q206L; N18R-N76D-S78N-S87R-G118R-S128L-P129Q-S130A-Q206L-H249R; N18R-S24R-N76D-S78N-S87R-G118R-S128L-P129Q-S130A-Q206L-H249N; N18R-S24R-N76D-S78N-S87R-S99N-G118R-S128L-P129Q-S130A-A158T-Q206L-I246V-H249R; S24R-N76D-S78N-S128L-P129Q-S130A-Q206L-H249R; N18R-S24R-N76D-S78N-S128L-P129Q-S130A-Q206L-H249R; N76D-S78N-G118R-Q206L-H249R; N18R-144V-N76D-S78N-S87R-S128L-P129Q-S130A-Q206L-H249R; N18R-N76D-S78N-S87R-Q206L-H249R; N18R-S24R-N76D-S78N-S87R-S128L-P129Q-S130A-Q206L; N76D-S78N-G118R-Q206L; A16T-N18R-S24R-N76D-S78N-G118R-S128L-P129Q-S130A-Q206L; N18R-S24R-N76D-S78N-S87R-G118R-S128L-P129Q-S130A-Q206L-K235T; S24R-N76D-S78N-Q206L-H249R; S24R-N76D-S78N-S87R-S128L-P129Q-S130A-Q206L; N18R-N76D-S78N-S128L-P129Q-S130A-Q206L; N18R-S24R-N76D-S78N-S128L-P129Q-S130A; S24R-N76D-S78N-H249R; N18R-S24R-N76D-S78N-S87R-G118R-S128L-P129Q-S130A-Q206L-A270T; N18R-S24R-N76D-S78N-G118R-S128L-P129Q-S130A-H249R; N18R-S24R-N76D-S78N-M222Q-H249R; N76D-S78N-S87R-Q206L-H249R; N18R-N76D-S78N-Q206L-H249R; N18R-S24R-N76D-S78N-G118R-Q206L-K251R; N76D-S78N-Q206L-H249R; N18R-S24R-N76D-S78N-S87R-Q206L; N18R-S24R-N76D-S78N-G118R-S128L-P129Q-S130A; N76D-S78N-H120R-Q206L-H249R; N18R-N76D-S78N-S87R-S128L-P129Q-S130A-Q206L-H249R; N18R-G20E-N76D-S78N-G118R-H249R; S24R-N76D-S78N-G118R-S128L-P129Q-S130A; N76D-S78N-G118R-S128L-P129Q-S130A-Q206L-H249R; S24R-N76D-S78N-G118R-Q206L; N18R-N76D-S78N-S128L-P129Q-S130A-Q206L-V268A; N18R-N76D-S78N-S87R-Q206L-N218S-M222Q-H249R; N18R-S24R-N76D-S78R-G118R-S128L-P129Q-S130A-H249R; N76D-S78N-S87R-G118R-S128L-P129Q-S130A; N18R-S24R-N76D-S78N-H249R; N18R-S24R-N76D-S78N-S87R-G118R-S128L-P129Q-S130A-H249R; N18R-S24R-N76D-S78N-S87R-H249R; N76D-S87R-G118R-S128L-P129Q-S130A-Q206L; N76D-S78N-S87R-G118R-S128L-P129Q-S130A-Q206L; N18R-S24R-N76D-S78N-Q206L-H249R; N18R-S24R-N76D-S78N-S87R-G118R-S128L-P129Q-S130A-Q206L-H249R; N76D-S78N-S87R-G118R-S128L-P129Q-S130A-M222Q; S24R-N76D-S87R-Q206Y-T213A-M222Q-H249R; S24R-N76D-S78N-S87R-G118R-Y209W-M222Q-H249R; S87R-Q206L-Y209W-T213A-H249R; S24R-N76D-S78N-S87R-G118R-Q206L-M222Q; S24R-N76D-S78N-Q206L-M222Q; N76D-S78N-S87R-G118R-S128L-P129Q-Q206L-M222Q; N76D-S78N-S87R-G118R-P129Q-Q206L-M222Q; N76D-S78N-S87R-G118R-S130A-Q206L-M222Q; N76D-S78N-S87R-G118R-S128L-P129Q-Q206L; N76D-S78N-S87R-G118R-S128L-S130A-Q206L; N76D-S78N-S87R-G118R-S128L-Q206L; N76D-S78N-S87R-G118R-P129Q-Q206L; N76D-S78N-S87R-G118R-S130A-Q206L; N76D-S78N-S87R-G118R-Q206L-M222Q; N76D-S78N-S87R-G118R-Q206L; S24R-N76D-S78N-S87R-G118R-Y209W-M222Q; S24R-N43R-N76D-S78N-S87R-G118R-Y209W-M222Q; G20R-S24R-N43R-N76D-S78N-S87R-G118R-Y209W-M222Q; G20R-N43R-N76D-S78N-S87R-G118R-Y209W-M222Q; S24R-N76D-S78N-S87R-G118R-Q206L-Y209W-T213A-M222Q; S24R-N76D-S78N-S87R-G118R-Q206L-T213A-M222Q; S24R-N76D-S78N-S87R-G118R-Y209W-T213A-M222Q; S24R-N76D-S78N-S87R-N116L-G118R-Y209W-M222Q; G20R-S24R-N43R-N76D-S78N-S87R-N116L-G118R-Y209W-M222Q; N18R-N76D-S78N-S128L-P129Q-S130A-Q206L-Y209W-H249R; N18R-S87D-S166N-Q206L-Y209W; N18R-S24R-N76D-S78N-S87R-G118R-G127T-Y209W-T213A; N18R-S24R-S166D-

Q206Y-H249R; S24R-S78N-S87R-S166D-Q206L-Y209W-H249R; S3V-N76D-S78N-S87R-G118R-S128L-P129Q-S130A-Q206L; N76D-S78N-S87R-S101V-G118R-S128L-P129Q-S130A-Q206L; N76D-S78N-S87R-G118R-G127T-S128L-P129Q-S130A-Q206L; N76D-S78N-S87R-S101G-S103A-V104I-G118R-Q206L; N76D-S78N-S87R-G118R-G127T-Q206L; N76D-S78N-S87R-G118R-G127T-P129Q-Q206L; N76D-S78N-S87R-G118R-G127T-P129Q-S130A-Q206L; N76D-S78N-S87R-S101G-S103A-V104I-G118R-G127T-P129R-Q206L; N76D-S78N-S87R-G118R-S128L-P129Q-S130A-Q206L-S212D; N76D-S78N-S87R-G118R-S128L-P129Q-S130A-S166D-Q206L; S3V-N76D-S78N-S87R-S101G-S103A-V104I-G118R-S128L-P129Q-S130A-Q206L; N76D-S78N-S87R-G118R-S128L-P129Q-S130A-Q206L-T213A; N76D-S78N-S87R-G118R-S128L-P129Q-S130A-Q206L-A232V-Q245R; N76D-S78N-S87R-G118R-S128L-P129Q-S130A-G159D-S188D-Q206L-A232V-Q245R; S3V-S24R-N76D-S78N-S87D-G118R-Y209W-M222Q-H249R; S24R-N76D-S78N-S87D-S101V-G118R-Y209W-M222Q-H249R; S24R-N76D-S78N-S87D-S101G-S103A-V104I-G118R-Y209W-M222Q-H249R; S24R-N76D-S78N-S87D-G118R-Y209W-M222Q-H249R-S212D; S3V-S24R-N76D-S78N-S87D-S101G-S103A-V104I-G118R-Y209W-M222Q-H249R; S24R-N76D-S78N-S87D-S101G-S103A-V104I-G118R-G127T-Y209W-T213A-M222Q-H249R; S024R-N074D-S76N-S085D-S099G-S101A-V102I-G116R-Y203W-M216Q-A226V-Q239R-H243R; S24R-N76D-S78N-S87D-S101G-S103A-V104I-G118R-Y209W-H249R; S3V-S24R-N76D-S78N-S87D-S101G-S103A-V104I-G118R-Y209W-H249R; S24R-N76D-S78N-S87D-S101G-S103A-V104I-G118R-G127T-Y209W-T213A-H249R; S24R-N76D-S78N-S87D-S101T-G118R-Y209W-M222Q-H249R; S24R-N76D-S78N-S87D-S101H-G118R-Y209W-M222Q-H249R; S24R-N76D-S78N-S87D-G118R-P129Q-Y209W-M222Q-H249R; N76D-S78N-S87D-G118R-S128L-P129Q-S130A-Q206L; S24R-N76D-S78N-S87R-G118R-S128L-P129Q-S130A-Q206L-H249R; N18R-S24R-N76D-S78N-S87R-G118R-S128L-P129Q-S130A-Q206L; S24R-N76D-S78N-S87R-G118R-S128L-P129Q-S130A-Q206L; S24R-N76D-S78N-S87D-G118R-Y209W-H249R; S24R-N76D-S78N-S87R-G118R-Y209W-M222Q-H249R; N76D-S78N-S87R-G118R-S128L-P129Q-S130A-Y209W; N76D-S78N-S87R-G118R-S128L-P129Q-S130A-Q206L-Y209W; N76D-S87R-S128L-P129Q-S130A-Q206L-Y209W-H249R; N76D-S87R-S128L-P129Q-S130A-Q206L-Y209W; S24R-N76D-S78N-S87D-G118R-Y209W-M222S-H249R; N76D-S78N-S87D-G118R-Y209W-H249R; N76D-S78N-S87D-G118R-Y209W-M222S-H249R; S24R-N76D-S78N-S87D-G118R-M222Q-H249R; N76D-S78N-S87R-G118R-S128L-P129Q-S130A-Q206L-M222S; S3T-N76D-S78N-S87R-G118R-S128L-P129Q-S130A-Q206L; V28T-N76D-S78N-S87R-G118R-S128L-P129Q-S130A-Q206L; N76D-S78N-S87R-A108S-G118R-S128L-P129Q-S130A-Q206L; N76D-S78N-S87R-N116M-G118R-S128L-P129Q-S130A-Q206L; N76D-S78N-S87R-G118R-L124M-S128L-P129Q-S130A-Q206L; N76D-S78N-S87R-G118R-S128L-P129Q-S130A-V150T-Q206L; N76D-S78N-S87R-G118R-S128L-P129Q-S130A-A194D-Q206L; N76D-S78N-S87R-G118R-S128L-P129Q-S130A-A158E-Q206L; V28T-N76D-S78N-S87R-S101F-G118R-S128L-P129Q-S130A-A194D-Q206L; S24R-V28T-N43S-N76D-S78N-S87R-G118R-S128L-P129Q-S130A-A158E-Q206L; S24R-V28T-N76D-S78N-S87R-G118R-S128L-P129Q-S130A-A194D-Q206L; S24R-N76D-S78N-S87D-G118R-S128L-P129Q-S130A-Q206L-T213A; S24R-V28T-N76D-S78N-S87D-S101V-A108S-G118R-S128L-P129Q-S130A-Q206L; S24R-V28T-N76D-S78N-S87D-S101V-N116M-G118R-S128L-P129Q-S130A-A158E-Q206L; S24R-N76D-S78N-S87R-G118R-S128L-P129Q-S130A-Q206L-T213A; N76D-S78N-S87R-S103D-G118R-S128L-P129Q-S130A-Q206L; S24R-V28T-N76D-S78N-S87R-S101V-A108S-G118R-S128L-P129Q-S130A-Q206L-T213A-L217K; S24R-N76D-S78N-S87R-G118R-S128L-P129Q-S130A-Q206L-L217K; S3V-S24R-N76D-S78N-S87R-G100S-S101V-G118R-Q206L-L217K; N76D-N77D-S78N-S87R-G118R-Q206L-T213A; S24R-N76D-S78N-S87D-G100S-S101V-N116M-G118R-L124M-S128L-P129Q-S130A-A194D-Q206L; S24R-V28T-N76D-S78N-S87R-G118V-S128L-P129Q-S130A-Q206L-T213A-L217K; S3V-N76D-S78N-S87R-G118R-S128L-P129Q-S130A; S3V-N76D-S78N-S87R-G118R-S128L-P129Q-S130A-Y209W; N76D-S78G-S87R-G118R-S128L-P129Q-S130A-Q206F; N76D-S78G-S87R-G118R-S128L-P129Q-S130A-Q206Y; S3V-N76D-S78G-S87R-G118R-S128L-P129Q-S130A-Q206F; S3V-N76D-S78G-S87R-G118R-S128L-P129Q-S130A-Q206M; S3V-N76D-S78G-S87R-G118R-S128L-P129Q-S130A-Q206Y; N76D-S78N-S87R-G118R-S128L-P129Q-S130A-Q206F; N76D-S78N-S87R-G118R-S128L-P129Q-S130A-Q206M; N76D-S78N-S87R-G118R-S128L-P129Q-S130A-Q206Y; S3V-N76D-S78N-S87R-G118R-S128L-P129Q-S130A-Q206F; S3V-N76D-S78N-S87R-G118R-S128L-P129Q-S130A-Q206M; S3V-N76D-S78N-S87R-G118R-S128L-P129Q-S130A-Q206Y; P40E-N76D-S87R-G118R-S128L-P129Q-S130A; 18V-P40E-N76D-S87R-G118R-S128L-P129Q-S130A; P40E-N76D-S87R-G118R-S128L-P129Q-S130A-P210I; P40E-N76D-S87R-G118R-S128L-P129Q-S130A-G211P; P40E-N76D-S87R-G118R-S128L-P129Q-S130A-N261I; N76D-S78N-S87R-G118R-S128L-P129Q-S130A-P210I; N76D-S78N-S87R-G118R-S128L-P129Q-S130A-Y209W-L262Q; N76D-S78N-S87R-G118R-S128L-P129Q-S130A-P210I-L262Q; N76D-S78N-S87R-G118R-S128L-P129Q-S130A-V147I-A194P-A215V-E271D; T22W-N76D-S78N-S87R-G118R-S128L-P129Q-S130A-V147I-A194P-A215V; T22W-N76D-S78N-S87R-G118R-S128L-P129Q-S130A-V147I-A215V-E271D; N76D-S87R-G118R-S128L-P129Q-S130A-L217K; N76D-S78N-S87R-G118R-S128L-P129Q-S130A-L217K; N76D-S78N-S87R-G118R-S128L-P129Q-S130A-V150T; N76D-S78G-S87R-G118R-S128L-P129Q-S130A-P210L; N76D-S87R-E89H-G118R-S128L-P129Q-S130A-Q206Y; S3V-N76D-S87R-E89H-G118R-S128L-P129Q-S130A-P210L; N76D-S78Q-S87R-G118R-S128L-P129Q-S130A-Q206D; N76D-S78T-S87R-G118R-S128L-P129Q-S130A-Q206D; N76D-S78V-S87R-G118R-S128L-P129Q-S130A-Q206D; N76D-S78W-S87R-G118R-S128L-P129Q-S130A-Q206D; N76D-S78Y-S87R-G118R-S128L-P129Q-S130A-Q206D; N76D-S78A-S87R-G118R-S128L-P129Q-S130A-Q206F; N76D-S78C-S87R-G118R-S128L-P129Q-S130A-Q206F; N76D-S78E-S87R-G118R-S128L-P129Q-S130A-Q206F; N76D-S78F-S87R-G118R-S128L-P129Q-S130A-Q206F; N76D-S78H-S87R-G118R-S128L-P129Q-S130A-Q206F; N76D-S78K-S87R-G118R-S128L-P129Q-S130A-Q206F; N76D-S78L-S87R-G118R-S128L-P129Q-S130A-Q206F; N76D-S78M-S87R-G118R-S128L-P129Q-S130A-Q206F; N76D-S78Q-S87R-G118R-S128L-P129Q-S130A-Q206F; N76D-S78T-S87R-G118R-S128L-P129Q-S130A-Q206F; N76D-S78W-S87R-G118R-S128L-P129Q-S130A-Q206F; N76D-S78Y-S87R-G118R-S128L-P129Q-S130A-Q206F; N76D-S78C-S87R-G118R-S128L-P129Q-S130A-Q206G; N76D-S78M-S87R-G118R-S128L-P129Q-S130A-Q206G; N76D-S78C-S87R-G118R-S128L-P129Q-S130A-Q206H; N76D-S78E-S87R-G118R-S128L-P129Q-S130A-Q206H; N76D-S78F-S87R-

G118R-S128L-P129Q-S130A-Q206H; N76D-S78G-S87R-G118R-S128L-P129Q-S130A-Q206H; N76D-S78H-S87R-G118R-S128L-P129Q-S130A-Q206H; N76D-S78L-S87R-G118R-S128L-P129Q-S130A-Q206H; N76D-S78T-S87R-G118R-S128L-P129Q-S130A-Q206H; N76D-S78V-S87R-G118R-S128L-P129Q-S130A-Q206H; N76D-S78A-S87R-G118R-S128L-P129Q-S130A-Q206M; N76D-S78C-S87R-G118R-S128L-P129Q-S130A-Q206M; N76D-S78E-S87R-G118R-S128L-P129Q-S130A-Q206M; N76D-S78F-S87R-G118R-S128L-P129Q-S130A-Q206M; N76D-S78G-S87R-G118R-S128L-P129Q-S130A-Q206M; N76D-S78I-S87R-G118R-S128L-P129Q-S130A-Q206M; N76D-S78K-S87R-G118R-S128L-P129Q-S130A-Q206M; N76D-S78L-S87R-G118R-S128L-P129Q-S130A-Q206M; N76D-S78M-S87R-G118R-S128L-P129Q-S130A-Q206M; N76D-S78Q-S87R-G118R-S128L-P129Q-S130A-Q206M; N76D-S78R-S87R-G118R-S128L-P129Q-S130A-Q206M; N76D-S78T-S87R-G118R-S128L-P129Q-S130A-Q206M; N76D-S78V-S87R-G118R-S128L-P129Q-S130A-Q206M; N76D-S78Y-S87R-G118R-S128L-P129Q-S130A-Q206M; N76D-S78A-S87R-G118R-S128L-P129Q-S130A-Q206N; N76D-S78C-S87R-G118R-S128L-P129Q-S130A-Q206N; N76D-S78E-S87R-G118R-S128L-P129Q-S130A-Q206N; N76D-S78G-S87R-G118R-S128L-P129Q-S130A-Q206N; N76D-S78H-S87R-G118R-S128L-P129Q-S130A-Q206N; N76D-S78I-S87R-G118R-S128L-P129Q-S130A-Q206N; N76D-S78L-S87R-G118R-S128L-P129Q-S130A-Q206N; N76D-S78M-S87R-G118R-S128L-P129Q-S130A-Q206N; N76D-S78Q-S87R-G118R-S128L-P129Q-S130A-Q206N; N76D-S78R-S87R-G118R-S128L-P129Q-S130A-Q206P; N76D-S78W-S87R-G118R-S128L-P129Q-S130A-Q206P; N76D-S78A-S87R-G118R-S128L-P129Q-S130A-Q206R; N76D-S78C-S87R-G118R-S128L-P129Q-S130A-Q206R; N76D-S78E-S87R-G118R-S128L-P129Q-S130A-Q206R; N76D-S78F-S87R-G118R-S128L-P129Q-S130A-Q206R; N76D-S78G-S87R-G118R-S128L-P129Q-S130A-Q206R; N76D-S78H-S87R-G118R-S128L-P129Q-S130A-Q206R; N76D-S78I-S87R-G118R-S128L-P129Q-S130A-Q206R; N76D-S78L-S87R-G118R-S128L-P129Q-S130A-Q206R; N76D-S78M-S87R-G118R-S128L-P129Q-S130A-Q206R; N76D-S78P-S87R-G118R-S128L-P129Q-S130A-Q206R; N76D-S78Q-S87R-G118R-S128L-P129Q-S130A-Q206R; N76D-S78R-S87R-G118R-S128L-P129Q-S130A-Q206R; N76D-S78T-S87R-G118R-S128L-P129Q-S130A-Q206R; N76D-S78V-S87R-G118R-S128L-P129Q-S130A-Q206R; N76D-S78C-S87R-G118R-S128L-P129Q-S130A-Q206S; N76D-S78E-S87R-G118R-S128L-P129Q-S130A-Q206S; N76D-S78H-S87R-G118R-S128L-P129Q-S130A-Q206S; N76D-S78M-S87R-G118R-S128L-P129Q-S130A-Q206S; N76D-S78W-S87R-G118R-S128L-P129Q-S130A-Q206S; N76D-S78C-S87R-G118R-S128L-P129Q-S130A-Q206Y; N76D-S78E-S87R-G118R-S128L-P129Q-S130A-Q206Y; N76D-S78H-S87R-G118R-S128L-P129Q-S130A-Q206Y; N76D-S78I-S87R-G118R-S128L-P129Q-S130A-Q206Y; N76D-S78K-S87R-G118R-S128L-P129Q-S130A-Q206Y; N76D-S78L-S87R-G118R-S128L-P129Q-S130A-Q206Y; N76D-S78M-S87R-G118R-S128L-P129Q-S130A-Q206Y; N76D-S78Q-S87R-G118R-S128L-P129Q-S130A-Q206Y; N76D-S78R-S87R-G118R-S128L-P129Q-S130A-Q206Y; N76D-S78T-S87R-G118R-S128L-P129Q-S130A-Q206Y; N76D-S78W-S87R-G118R-S128L-P129Q-S130A-Q206Y; N76D-S78Y-S87R-G118R-S128L-P129Q-S130A-Q206Y; N76D-S78H-S87R-G118R-S128L-P129Q-S130A-Q206A; N76D-S78H-S87R-G118R-S128L-P129Q-S130A-Q206D; N76D-S78I-S87R-G118R-S128L-P129Q-S130A-Q206D; N76D-S78L-S87R-G118R-S128L-P129Q-S130A-Q206D; N76D-S78P-S87R-G118R-S128L-P129Q-S130A-Q206D; N76D-S78C-S87R-G118R-S128L-P129Q-S130A-Q206A; N76D-S78Q-S87R-G118R-S128L-P129Q-S130A-Q206A; N76D-S78A-S87R-G118R-S128L-P129Q-S130A-Q206D; N76D-S78C-S87R-G118R-S128L-P129Q-S130A-Q206D; N76D-S78E-S87R-G118R-S128L-P129Q-S130A-Q206D; N76D-S78G-S87R-G118R-S128L-P129Q-S130A-Q206D; N76D-S78M-S87R-G118R-S128L-P129Q-S130A-Q206D; N76D-S78M-S87R-G118R-S128L-P129Q-S130A-Q206H; N76D-S78A-S87R-G118R-S128L-P129Q-S130A-Q206H; N76D-S78H-S87R-G118R-S128L-P129Q-S130A-Q206M; S3V-S24R-N76D-S78N-S87D-G118R-Y209W-H249R; S3V-N76D-S78N-S87D-G118R-Y209W-H249R; S3I-N43Y-L82D-G127S-S216Y-L217K-S256P; G127S-S216Y; S3V-I8V-P40E-N76D-S87D-G118R-S128R-A215K-N261I; S3V-18V-P40E-N76D-G118R-S128R-P210I-N261I; S3V-P40E-N76D-S87D-G118R-S128R-P210I-L217K; S3V-N76D-G118R-S128R; S3V-N76D-S87D-G118R-S128R; S3V-N76D-G118R-S128R-P210I; S3V-N76D-G118R-S128R-N261I; S3V-P40E-N76D-G118R; S3V-P40E-N76D-G118R-S128R; S3V-18V-P40E-N76D-G118R-S128R; S3V-P40E-N76D-S87D-G118R-S128R; S3V-P40E-N76D-G118R-S128R-S160Q; S3V-P40E-N76D-G118R-S128R-P210I; S3V-P40E-N76D-G118R-S128R-G211P; S3V-P40E-N76D-G118R-S128R-A215K; S3V-P40E-N76D-G118R-S128R-L217K; S3V-P40E-N76D-G118R-S128R-N261I; S3V-P40E-N76D-G118R-S128R-L262Q; S3V-I8V-P40E-N76D-G118R; S3V-P40E-N76D-S87D-G118R; S3V-P40E-N76D-G118R-S160Q; S3V-P40E-N76D-G118R-Q206Y; S3V-P40E-N76D-G118R-P210I; S3V-P40E-N76D-G118R-G211P; S3V-P40E-N76D-G118R-A215; S3V-P40E-N76D-G118R-L217K; S3V-P40E-N76D-G118R-N261I; S3V-P40E-N76D-G118R-L262Q; S3V-N76D-G118R-S128R-G211P; S3V-N76D-G118R-S128R-L262Q; T22W-N76D-S78N-S87R-G118R-S128R-P129Q-S130A-V147I-A194P-A215V-E271D; N76D-S78N-S87R-G118R-S128R-P129Q-S130A; N76D-S78N-S87R-G118R-S128R-P129Q-S130A-V147I-A194P-A215V; N76D-S78N-S87R-G118R-S128R-P129Q-S130A-V147I-A194P-E271D; T22W-N76D-S78N-S87R-G118R-S128R-P129Q-S130A-A215V-E271D; T22W-N76D-S78N-S87R-G118R-S128R-P129Q-S130A-A194P-E271D; P40E-N76D-S78G-G118R-S128R-Q206Y-L262Q; S3V-P40E-N76D-G118R-G211P-L217K-N261I; 18V-P40E-N76D-S78G-G118R-Q206Y-L217K; S3V-I8V-N76D-S78G-S87D-G118R-P210I-A215K-N252I; S3V-P40E-N76D-G118R-S160Q-P210I-L217K-N261I; I8V-N76D-S78G-G118R-S160Q-Q206Y-N252I-N261I; 18V-P40E-N76D-G118R-P210I-A215K-N261I; I8V-P40E-N76D-S78G-G118R-Q206Y-P210I-A215K-N261I; S3V-N76D-G118R-S160Q-G211P-A215V-L262Q; S3V-N76D-S87D-G118R-S128R-P210I-G211P-N261I-L262Q; S3V-P40E-N76D-G118R-Q206Y-P210I-G211P-A215K-N261I; 18V-P40E-N76D-S78G-G118R-G211P-L217K-N252I-N261I; S3V-P40E-N76D-S87D-G118R-S128R-P210I-L217K-N261I; S3V-P40E-N76D-G118R-S160Q-P210I-W241K-L262Q; I8V-N76D-S78G-G118R-P210I-A215V-N261I; N76D-S78G-S87D-G118R-P210I-A215V-L217K-N261I-L262Q; S3V-P40E-N76D-S78G-G118R-Q206Y-L217K; S3V-P40E-N76D-S78G-G118R-S128L-P129Q-S130A-L217K; S3V-P40E-N76D-S78G-G118R-S128L-P129Q-S130A-Q206Y-P210I-A215V-L217K; N76D-S78N-S87D-G118R-S128L-P129Q-S130A-Q206Y; S3V-P40E-N76D-S78G-G118R-S128L-P129Q-S130A-A215K-N261I; S3V-N76D-S87D-G118R-S128L-P129Q-S130A-P210I-L217K; N76D-S87R-G118R-S128K-V150T-L217K; N76D-S78N-S87R-G118R-S128K-V150T-L217K; N76D-S78N-S87R-G118R-S128K-V150T; S3V-N76D-S78G-S87D-G118A-S166N-A194P-Q206M-

P210I-N218S-N248D-N261I-L262Q; S3V-N76D-S78G-S87T-S101Q-G118A-S130Q-S166N-A194P-P210I-N218S-N248D-S256P-N261I; S3V-N76D-S78G-S87D-S101Q-G118A-Q206M-P210I-L217K-N218S-M222Q-N248D-S256P; and S24L-N76D-S78N-S87D-A88S-G118R-Q206Y-Y209W-H249R; wherein said variant has proteolytic activity and each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence.

In a still further embodiment, one or more subtilisin variant described herein has 70, 75, 80, 85, 90, 91, 92, 93, 94, 95, 96, 97, 98, 99%, or less than 100% amino acid sequence identity to SEQ ID NO: 1, SEQ ID NO:2, or SEQ ID NO: 14. In another embodiment, one or more subtilisin variant described herein has one or more improved property when compared to a parent or benchmark protease, wherein the improved property is selected from improved protease activity, improved cleaning performance in detergent, and improved thermostability in detergent.

Another embodiment is directed to a composition comprising one or more subtilisin variant described herein with the proviso that the composition is not an automatic dishwashing composition. In yet other embodiments, the detergent composition is an automatic dishwashing detergent composition, a laundry composition, and/or a hand (manual) dishwashing composition. A further embodiment is directed to a method of cleaning an item or surface in need of cleaning, wherein the method comprises contacting the item or surface with one or more subtilisin variant or one or more composition described herein. A still further embodiment provides an isolated nucleic acid sequence comprising a polynucleotide sequence that encodes one or more subtilisin variant described herein; an expression vector comprising said isolated nucleic acid sequence; and/or a recombinant host cell comprising said expression vector.

FIG. 1 provides an alignment of the mature amino acid sequence of *B. lentus* subtilisin GG36 (SEQ ID NO: 1) and the mature amino acid sequence of *B. amyloliquefaciens* subtilisin BPN' (SEQ ID NO:2).

Unless otherwise indicated herein, the subtilisin variants described herein can be made and used via conventional techniques commonly used in molecular biology, microbiology, protein purification, protein engineering, protein and DNA sequencing, recombinant DNA fields, and industrial enzyme use and development. Any headings provided herein are provided for the benefit of the reader and not to limit the various embodiments that are apparent upon reading the specification as a whole. Any definitions provided herein are to be interpreted in the context of the specification as a whole. As used herein, the singular terms "a," "an," and "the" include the plural reference unless the context clearly indicates otherwise. Unless otherwise indicated herein, nucleic acids are written left to right in 5' to 3' orientation; amino acid sequences are written left to right in amino to carboxy orientation, respectively. Each numerical range used herein includes every narrower numerical range that falls within such broader numerical range, as if such narrower numerical ranges were all expressly written herein.

Each amino acid position of each protease variant described herein is numbered according to the numbering of the corresponding amino acid position in the amino acid sequence of *B. amyloliquefaciens* subtilisin protease BPN' (SEQ ID NO: 1) as determined through the FIG. 1 alignment of the GG36 sequence (SEQ ID NO:2) with the BPN' sequence. For example, the starting amino acid of each amino acid substitution in each subtilisin variant for which the parental protease is GG36 will be as set forth in the GG36 parental sequence, and not as set forth in the BPN' sequence. That is, reference is made to the BPN' sequence to identify the position—and not the starting amino acid—of each substitution contained in one or more subtilisin variant described. Accordingly, a given amino acid sequence, such as the amino acid sequence of a subtilisin variant described herein, can be aligned with the BPN' sequence using an alignment algorithm such as, e.g., BLAST, MUSCLE, or CLUSTAL described hereinbelow, and an amino acid residue in the given amino acid sequence that aligns (preferably optimally aligns) with an amino acid residue in the BPN' sequence can be conveniently numbered by reference to the corresponding amino acid residue in the subtilisin BPN' sequence.

The amino acid substitutions of the one or more subtilisin variant described herein is described using one or more of following nomenclatures: position or starting amino acid: position:substituted amino acid(s). Reference to only a position encompasses any starting amino acid that may be present in a parent or benchmark molecule at that position and any amino acid to which such starting amino acid may be substituted (i.e., the substituted amino acid necessarily excludes the starting amino acid of such parent or benchmark molecule). Reference to a substituted amino acid may be further expressed as several substituted amino acids separated by a foreslash ("/"). For example, X130A/N-209-213 represents a three amino acid substitution combination, wherein X is any starting amino acid at position 130 that can be substituted with an alanine (A) or an asparagine (N); 209 represents a position where any starting amino acid can be substituted with an amino acid that is not the starting amino acid; and 213 represents a position where any starting amino acid can be substituted with an amino acid that is not the starting amino acid. By way of further example, S101F/G/H/T/V represents five possible substitutions at position 101, wherein the starting amino acid serine (S) can be substituted with a phenylalanine (F), glycine (G), histidine (H), threonine (T), or valine (V).

"Subtilisin" and "subtilisin protease" refer to any member of the S8 serine protease family as described in MEROPS—The Peptidase Data base (Rawlings et al., MEROPS: the peptidase database, Nucl. Acids Res. 34 Database issue, D270-272 (2006)). As described therein, the peptidase family S8 contains the serine endopeptidase subtilisin and its homologues (Biochem. J. 290:205-218 (1993)). Many *Bacillus* species (*Bacillus* sp.) secrete large amounts of subtilisins.

"Protease variant", "variant protease", and "subtilisin variant" refer to a protease that differs in amino acid sequence from the amino acid sequence of a reference protease (which may be a parent or benchmark protease) by one or more amino acid, such as by one or more amino acid substitution, deletion, an/or addition. The proteolytic activity of such variant may be determined using procedures well known in the art and/or described herein.

The genus "*Bacillus*" includes all species within the genus *Bacillus*, as known to those of skill in the art, including, but not limited to, e.g., *B. subtilis, B. licheniformis, B. lentus, B. brevis, B. stearothermophilus, B. alkalophilus, B. amyloliquefaciens, B. clausii, B. halodurans, B. megaterium, B. coagulans, B. circulans, B. lautus,* and *B. thuringiensis*. It is recognized that the genus *Bacillus* continues to undergo taxonomical reorganization. Thus, it is intended that the genus include species that have been reclassified, including, but not limited to, such organisms as *B. stearothermophilus*, which is now named "*Geobacillus stearothermophilus*." The production of resistant endospores in the presence of oxygen is considered a defining feature of the genus *Bacillus*, although this characteristic also applies to the recently named *Alicyclobacillus, Amphibacillus, Aneurinibacillus, Anoxybacillus, Brevibacillus, Filobacillus, Gracilibacillus, Halobacillus, Paenibacillus, Salibacillus, Thermobacillus, Ureibacillus*, and *Virgibacillus*.

"Polynucleotide" and "nucleic acid," which are used interchangeably herein, refer to a polymer of any length of nucleotide monomers covalently bonded in a chain. DNA (deoxyribonucleic acid), a polynucleotide comprising deoxyribonucleotides, and RNA (ribonucleic acid), a polymer of ribonucleotides, are examples of polynucleotides or nucleic acids having distinct biological function. Polynucleotides or nucleic acids include, but are not limited to, a single-, double- or triple-stranded DNA, genomic DNA, cDNA, RNA, DNA-RNA hybrid, or a polymer comprising purine and pyrimidine bases. The following are non-limiting examples of polynucleotides: genes, gene fragments, chromosomal fragments, expressed sequence tag(s) (EST(s)), exons, introns, messenger RNA (mRNA), transfer RNA (tRNA), ribosomal RNA (rRNA), ribozymes, complementary DNA (cDNA), recombinant polynucleotides, branched polynucleotides, plasmids, vectors, isolated DNA of any sequence, isolated RNA of any sequence, nucleic acid probes, and primers. In some embodiments, polynucleotides comprise modified nucleotides, such as methylated nucleotides and nucleotide analogs, uracyl, other sugars and linking groups such as fluororibose and thioate, and nucleotide branches. In a particular embodiment, a sequence of nucleotides is interrupted by non-nucleotide components.

"Vector" refers to a nucleic acid construct or polynucleotide construct used to introduce or transfer nucleic acid(s) or polynucleotide(s) into a target cell or tissue. A vector is typically used to introduce foreign DNA into another cell or tissue. A vector generally comprises a DNA sequence that is a transgene and a larger polynucleotide sequence that serves as the "backbone" of the vector. The vector typically serves to transfer genetic information, such as the inserted transgene, to a target cell or tissue so as to isolate, multiply, or express the insert transgene in the target cell or tissue. Vectors include, but are not limited to, plasmids, cloning vectors, bacteriophages, viruses (e.g., viral vector), cosmids, expression vectors, shuttle vectors, and cassettes. A vector typically includes an origin of replication, a multicloning site, and a selectable marker. The process of inserting a vector into a target cell is typically referred to as transfection. The transfection of a cell with a viral vector is typically referred to as transduction. In one embodiment, one or more vector described herein comprises a DNA sequence encoding one or more subtilisin variant described herein (e.g., precursor or mature subtilisin variant) that is operably linked to a suitable prosequence (e.g., secretory, signal peptide sequence, etc.) capable of effecting the expression of the DNA sequence in a suitable host.

"Expression cassette" or "expression vector" refers to a nucleic acid construct or vector generated recombinantly or synthetically for the expression of a nucleic acid of interest (e.g., a foreign nucleic acid or transgene) in a target cell. The nucleic acid of interest typically expresses a protein of interest. An expression vector or expression cassette typically comprises a promoter nucleotide sequence that drives or promotes expression of the foreign nucleic acid. The expression vector or cassette also typically includes other specified nucleic acid elements that permit transcription of a particular nucleic acid in a target cell. A recombinant expression cassette can be incorporated into a plasmid, chromosome, mitochondrial DNA, plastid DNA, virus, or nucleic acid fragment. Some expression vectors have the ability to incorporate and express heterologous DNA fragments in a host cell or genome of the host cell. Many prokaryotic and eukaryotic expression vectors are commercially available. Selection of appropriate expression vectors for expression of a protein from a nucleic acid sequence incorporated into the expression vector is within the knowledge of those of skill in the art.

A DNA construct is an artificially constructed segment of nucleic acid that may be introduced into a target cell or tissue. A DNA construct typically comprises a DNA insert comprising a nucleotide sequence encoding a protein of interest that has been subcloned into a vector. The vector may contain bacterial resistance genes for growth in bacteria and a promoter for expression of the protein of interest in an organism. The DNA may be generated in vitro by PCR or any other suitable technique(s) known to those in the art. In some embodiments, the DNA construct comprises a nucleic acid sequence of interest. In some embodiments, the sequence is operably linked to additional elements such as control elements (e.g., promoters, etc.). The DNA construct may further comprise a selectable marker and may further comprise an incoming sequence flanked by homology boxes. The construct may comprise other non-homologous sequences, added to the ends (e.g., stuffer sequences or flanks). In some embodiments, the ends of the sequence are closed such that the DNA construct forms a closed circle. The nucleic acid sequence of interest, which is incorporated into the DNA construct, using techniques well known in the art, may be a wild-type, mutant, or modified nucleic acid. In some embodiments, the DNA construct comprises one or more nucleic acid sequences homologous to the host cell chromosome. In other embodiments, the DNA construct comprises one or more non-homologous nucleotide sequences. Once the DNA construct is assembled in vitro it may be used, for example, to: 1) insert heterologous sequences into a desired target sequence of a host cell; 2) mutagenize a region of the host cell chromosome (i.e., replace an endogenous sequence with a heterologous sequence); 3) delete target genes; and/or 4) introduce a replicating plasmid into the host. "DNA construct" is used interchangeably herein with expression cassette.

"Plasmid" refers to an extrachromosomal DNA molecule which is capable of replicating independently from the chromosomal DNA. A plasmid is double stranded (ds), may be circular, and is typically used as a cloning vector.

"Introduce", when used in the context of introducing a nucleic acid sequence into a cell, refers to any method suitable for transferring the nucleic acid sequence into the cell. Such methods for introduction include but are not limited to protoplast fusion, transfection, transformation, electroporation, conjugation, and transduction (see, e.g., Ferrari et al., "Genetics," in Hardwood et al. (eds.), *Bacillus*, Plenum Publishing Corp., pp. 57-72 (1989)).

A nucleic acid is "operably linked" with another nucleic acid sequence when it is placed into a functional relationship with another nucleic acid sequence. For example, a promoter or enhancer is operably linked to a nucleotide coding sequence if the promoter affects the transcription of the coding sequence. A ribosome binding site may be operably linked to a coding sequence if it is positioned so as to facilitate translation of the coding sequence. Typically, "operably linked" DNA sequences are contiguous. However, enhancers do not have to be contiguous. Linking is accomplished by ligation at convenient restriction sites. If such sites do not exist, synthetic oligonucleotide adaptors or linkers may be used in accordance with conventional practice.

"Gene" refers to a polynucleotide (e.g., a DNA segment), that encodes a polypeptide and includes regions preceding and following the coding regions as well as intervening sequences (introns) between individual coding segments (exons).

"Recombinant" when used with reference to a cell typically indicates that the cell has been modified by the introduction of a heterologous nucleic acid sequence or that the cell is derived from a cell so modified. For example, a recombinant cell may comprise a gene not found in identical form within the native (non-recombinant) form of the cell, or a recombinant cell may comprise a native gene (found in the native form of the cell) but which has been modified and re-introduced into the cell. A recombinant cell may comprise a nucleic acid endogenous to the cell that has been modified without removing the nucleic acid from the cell. Such modifications include those obtained by gene replacement, site-specific mutation, and related techniques known to those of ordinary skill in the art. Recombinant DNA technology includes techniques for the production of recombinant DNA in vitro and transfer of the recombinant DNA into cells where it may be expressed or propagated, thereby producing a recombinant polypeptide. "Recombination," "recombining," and "recombined" of polynucleotides or nucleic acids refer generally to the assembly or combining of two or more nucleic acid or polynucleotide strands or fragments to generate a new polynucleotide or nucleic acid. The recombinant polynucleotide or nucleic acid is sometimes referred to as a chimera. A nucleic acid or polypeptide is "recombinant" when it is artificial or engineered, or derived from an artificial or engineered protein or nucleic acid.

Nucleic acid or gene "amplification" refers to a process by which specific DNA sequences are disproportionately replicated such that the amplified nucleic acid or gene becomes present in a higher copy number than was initially present in the genome. In some embodiments, selection of cells by growth in the presence of a drug (e.g., an inhibitor of an inhibitable enzyme) results in the amplification of either the endogenous gene encoding the gene product required for growth in the presence of the drug or by amplification of exogenous (i.e., input) sequences encoding this nucleic acid or gene product or both. Amplification is a special case of nucleic acid replication involving template specificity. It is to be contrasted with non-specific template replication (i.e., replication that is template-dependent but not dependent on a specific template). Template specificity is here distinguished from fidelity of replication (i.e., synthesis of the proper polynucleotide sequence) and nucleotide (ribo- or deoxyribo-) specificity. Template specificity is frequently described in terms of "target" specificity. Target sequences are "targets" in the sense that they are sought to be sorted out from other nucleic acid. Amplification techniques have been designed primarily for this sorting out.

"Primer" refers to an oligonucleotide (a polymer of nucleotide residues), whether occurring naturally as in a purified restriction digest or produced synthetically, which is capable of acting as a point of initiation of synthesis when placed under conditions in which synthesis of a primer extension product which is complementary to a nucleic acid strand is induced (i.e., in the presence of nucleotides and an inducing agent such as DNA polymerase and at a suitable temperature and pH). A primer is preferably single stranded for maximum efficiency in amplification, but may alternatively be double stranded. If double stranded, the primer is first treated to separate its strands before being used to prepare extension products. In one aspect, the primer is an oligodeoxyribonucleotide. The primer must be sufficiently long to prime the synthesis of extension products in the presence of the inducing agent. The exact length of a primer depends on a variety of factors, including temperature, source of primer, and the use of the method.

"Probe" refers to an oligonucleotide, whether occurring naturally as in a purified restriction digest or produced synthetically, recombinantly or by PCR amplification, which is typically capable of hybridizing to another oligonucleotide of interest. A probe may be single-stranded or double-stranded. Probes are useful in the detection, identification and isolation of particular gene sequences.

"Target", when used in reference to the polymerase chain reaction, refers to the region of nucleic acid bounded by the primers used for polymerase chain reaction. Thus, the "target" is sought to be sorted out from other nucleic acid sequences. A nucleotide "segment" is a region of a nucleic acid within the target nucleic acid sequence.

"Polymerase chain reaction" (PCR) refers to the methods of U.S. Pat. Nos. 4,683,195; 4,683,202; and 4,965,188, which include methods for increasing the concentration of a segment of a target sequence in a mixture of genomic DNA without cloning or purification. This process for amplifying the target sequence is well known in the art.

"Amplification reagents" refers to those reagents (e.g., deoxyribonucleotide triphosphates, buffer, etc.), needed for amplification except for primers, nucleic acid template, and the amplification enzyme. Typically, amplification reagents along with other reaction components are placed and contained in a reaction vessel (test tube, microwell, etc.).

"Restriction endonuclease" or "restriction enzyme" refers to an enzyme (e.g., bacterial enzyme) that is capable of cutting double-stranded or single-stranded DNA at or near a specific sequence of nucleotides known as a restriction site. The nucleotide sequence comprising the restriction site is recognized and cleaved by a given restriction endonuclease or restriction enzyme and is frequently the site for insertion of DNA fragments. A restriction site can be engineered into an expression vector or DNA construct.

"Homologous recombination" refers to the exchange of DNA fragments between two DNA molecules or paired chromosomes at the site of identical or nearly identical nucleotide sequences. In some embodiments, chromosomal integration is homologous recombination.

A nucleic acid or polynucleotide is said to "encode" a polypeptide if, in its native state or when manipulated by methods known to those of skill in the art, it can be transcribed and/or translated to produce the desired polypeptide. The anti-sense strand of such a nucleic acid is also said to encode the sequence. As is known in the art, a DNA sequence can be transcribed by an RNA polymerase to produce an RNA sequence, but an RNA sequence can be reverse transcribed by reverse transcriptase to produce a DNA sequence.

"Host strain" or "host cell" refers to a suitable host for an expression vector or cassette comprising a DNA sequence of interest. The DNA sequence of interest may express a protein of interest in the host strain or host cell.

A "protein" or "polypeptide" comprises a polymeric sequence of amino acid residues. The terms "protein" and "polypeptide" are used interchangeability herein. Due to the degeneracy of the genetic code, one or more nucleotide sequence may encode one or more subtilisin variant described herein.

"Prosequence" or "propeptide sequence" refers to an amino acid sequence between the signal peptide sequence and mature protease sequence that is necessary for the secretion of the protease. Cleavage of the prosequence or propeptide sequence results in a mature active protease.

"Signal sequence" or "signal peptide" refers to a sequence of amino acid residues that may participate in the secretion or direct transport of the mature or precursor form of a protein. The signal sequence is typically located N-terminal to the precursor or mature protein sequence. The signal sequence may be endogenous or exogenous. One exemplary exogenous signal sequence comprises the first seven amino acid residues of the signal sequence from *B. subtilis* subtilisin fused to the remainder of the signal sequence of the subtilisin from *B. lentus* (ATCC 21536). A signal sequence is normally absent from the mature protein. A signal sequence is typically cleaved from the protein by a signal peptidase after the protein is transported.

The "mature" form of a protein, polypeptide, or peptide refers to the functional form of the protein, polypeptide, or peptide without the signal peptide sequence and propeptide sequence.

The "precursor" form of a protein or peptide refers to a mature form of the protein having a prosequence operably linked to the amino or carbonyl terminus of the protein. The precursor may also have a "signal" sequence operably linked, to the amino terminus of the prosequence. The precursor may also have additional polynucleotides that are involved in post-translational activity (e.g., polynucleotides cleaved therefrom to leave the mature form of a protein or peptide).

"Wild-type" refers to an amino acid sequence or nucleic acid sequence that is a native or naturally occurring sequence.

"Homologous genes" refers to a pair of genes from different, but usually related species, which correspond to each other and which are identical or very similar to each other. The term encompasses genes that are separated by speciation (i.e., the development of new species) (e.g., orthologous genes), as well as genes that have been separated by genetic duplication (e.g., paralogous genes).

"Homology" refers to sequence similarity or identity, with identity being preferred. Homology can be determined by amino acid sequence alignment, e.g., using a program such as BLAST, MUSCLE, or CLUSTAL. Other techniques are described, for example, in Smith and Waterman, Adv. Appl. Math. 2:482 (1981); Needleman and Wunsch, J. Mol. Biol. 48:443 (1970); and Pearson and Lipman, Proc. Natl. Acad. Sci. USA 85:2444 (1988). BLAST is described by Altschul, et al., "Gapped BLAST and PSI BLAST a new generation of protein database search programs", Nucleic Acids Res., 25(17):3389-402 (1997); Altschul et al., J. Mol. Biol. 215: 403-410, (1990); and Karlin et al., Proc. Natl. Acad. Sci. USA 90:5873-5787 (1993). Software for performing BLAST analyses is publicly available through the National Center for Biotechnology Information. MUSCLE is described by Robert C. Edgar, "MUSCLE: multiple sequence alignment with high accuracy and high throughput", Nucl. Acids Res., 32 (5): 1792-1797 (2004). Software for performing MUSCLE analyses is available from Biomatters Ltd. The CLUSTAL W alignment algorithm is described by Thompson et al., Nucleic Acids Res, 22:4673-4680 (1994). Default parameters for the CLUSTAL W algorithm include: Gap opening penalty=10.0; Gap extension penalty=0.05; Protein weight matrix=BLOSUM series; DNA weight matrix=IUB; Delay divergent sequences %=40; Gap separation distance=8; DNA transitions weight=0.50; List hydrophilic residues=GPSNDQEKR; Use negative matrix=OFF; Toggle Residue specific penalties=ON; Toggle hydrophilic penalties=ON; and Toggle end gap separation penalty=OFF. In CLUSTAL algorithms, deletions occurring at either terminus are included. For example, a variant with a five amino acid deletion at either terminus (or within the polypeptide) of a polypeptide of 500 amino acids would have a percent sequence identity of 99% (495/500 identical residues×100) relative to the "reference" polypeptide. Such a variant would be encompassed by a variant having "at least 99% sequence identity" to the polypeptide.

The percent amino acid sequence identity of one or more subtilisin variant sequence described herein with a parent or benchmark sequence may be readily obtained by one skilled in the art. The percent amino acid identity shared by sequences of interest can be determined by aligning the sequences to directly compare the sequence information, e.g., by using a program such as BLAST, MUSCLE, or CLUSTAL. For example, the percent amino acid sequence identity of a subject sequence to a query sequence can be calculated by optimally aligning the two sequences and comparing the two optimally aligned sequences over the comparison length. The number of positions in the optimal alignment at which identical residues occur in both sequences are determined, thereby providing the number of matched positions, and the number of matched positions is then divided by the total number of positions of the comparison length (which, unless otherwise specified, is the length of the query sequence). The resulting number is multiplied by 100 to yield the percent amino acid sequence identity of the subject sequence to the query sequence.

"Optimal alignment" or "optimally aligned" refers to the alignment of two (or more) sequences giving the highest percent identity score. For example, optimal alignment of two protein sequences can be achieved by manually aligning the sequences such that the maximum number of identical amino acid residues in each sequence are aligned together or by using software programs or procedures described herein or known in the art. In one exemplary aspect, two polypeptide sequences are deemed "optimally aligned" when they are aligned using defined parameters, such as a defined amino acid substitution matrix, gap existence penalty (also termed gap open penalty), and gap extension penalty, so as to achieve the highest similarity score possible for that pair of sequences. The BLOSUM62 scoring matrix (Henikoff and Henikoff, Proc. Natl. Acad. Sci. USA 89(22):10915 (1992)) is often used as a default scoring substitution matrix in polypeptide sequence alignment algorithms (such as BLASTP). The gap existence penalty is imposed for the introduction of a single amino acid gap in one of the aligned sequences, and the gap extension penalty is imposed for each residue position in the gap. Exemplary alignment parameters employed are: BLOSUM62 scoring matrix, gap existence penalty=11, and gap extension penalty=1. The alignment score is defined by the amino acid positions of each sequence at which the alignment begins and ends (e.g., the alignment window), and optionally by the insertion of a gap or multiple gaps into one or both sequences, so as to achieve the highest possible similarity score.

A nucleic acid or polynucleotide is "isolated" when it is partially or completely separated from other components (such as, but not limited to, e.g., other proteins, nucleic acids, cells, etc.). Similarly, a polypeptide, protein or peptide is "isolated" when it is partially or completely separated from other components (such as, but not limited to, e.g., other proteins, nucleic acids, cells, etc.). On a molar basis, an isolated species is more abundant than are other species in a composition. For example, an isolated species may comprise at least about 50%, 70%, 80%, 85%, 90%, 91%, 92%, 93%, 94%, 95%, 96%, 97%, 98%, 99%, or 100% (on a molar basis) of all macromolecular species present. Preferably, the species of interest is purified to essential homogeneity (i.e., contaminant species cannot be detected in the composition by conventional detection methods). Purity and homogeneity can be determined using a number of techniques well known in the art, such as agarose or polyacrylamide gel electrophoresis of a protein or nucleic acid sample, followed by visualization upon staining. If desired, a high-resolution technique, such as high performance liquid chromatography (HPLC) or a similar means can be utilized for purification of the material.

"Purified" as applied to nucleic acids or polypeptides generally denotes a nucleic acid or polypeptide that is essentially free from other components as determined by analytical techniques well known in the art (e.g., a purified polypeptide or polynucleotide forms a discrete band in an electrophoretic gel, chromatographic eluate, and/or a media subjected to density gradient centrifugation). For example, a nucleic acid or polypeptide that gives rise to essentially one band in an electrophoretic gel is "purified." A purified nucleic acid or polypeptide is at least about 50% pure, usually at least about 75%, 80%, 85%, 90%, 91%, 92%, 93%, 94%, 95%, 96%, 97%, 98%, 99%, 99.5%, 99.6%, 99.7%, 99.8% or more pure (e.g., percent by weight on a molar basis). In one embodiment, an enzymatic composition containing one or more subtilisin variant and/or polynucleotide described herein can be enriched for said variant or polynucleotide by applying a purification or enrichment technique that is well-known in the art. A substantially pure subtilisin variant and/or polynucleotide described herein will typically comprise at least about 55%, 60%, 70%, 80%, 85%, 90%, 91%, 92%, 93%, 94%, 95%, 96%, 97%, 98, 99%, 99.5% or more by weight (on a molar basis) of all macromolecular species in a particular composition.

"Combinatorial mutagenesis" refers to methods in which libraries of nucleic acid variants of a reference nucleic acid sequence are generated. In these libraries, the variants contain one or several mutations chosen from a predefined set of mutations. The methods also provide means to introduce random mutations that were not members of the predefined set of mutations. Some such methods include, for example, those set forth in U.S. Pat. No. 6,582,914 and embodied in commercially available kits (e.g., QuikChange® Multi Site-Directed Mutagenesis Kit (Stratagene)).

"Modified nucleic acid sequence" and "modified gene" are used interchangeably herein to refer to a nucleic acid sequence that includes a deletion, insertion or interruption of naturally occurring (i.e., wild-type) nucleic acid sequence. In some embodiments, the expression product of the modified nucleic acid sequence is a truncated protein (e.g., if the modification is a deletion or interruption of the sequence). In some embodiments, the truncated protein retains biological activity. In alternative embodiments, the expression product of the modified nucleic acid sequence is an elongated protein (e.g., modifications comprising an insertion into the nucleic acid sequence). In some embodiments, a nucleotide insertion in the nucleic acid sequence leads to a truncated protein (e.g., when the insertion results in the formation of a stop codon). Thus, an insertion may result in either a truncated protein or an elongated protein as an expression product.

"Thermostability" refers to the amount of enzymatic activity a protease retains after being exposed to an altered temperature over a given period of time under conditions prevailing during, for example, the proteolytic, hydrolyzing, and/or cleaning process. Altered temperatures include increased or decreased temperatures. In one embodiment, thermostability is determined in the presence of one or more detergent component (e.g., surfactants, chelants, builders, etc) and/or one or more water hardness.

"Cleaning performance" refers to the cleaning activity a protease exhibits under conditions prevailing during the proteolytic, hydrolyzing, and/or cleaning process. In one embodiment, the cleaning performance of one or more subtilisin variant described herein or one or more reference protease may be determined by using one or more cleaning assay for one or more enzyme sensitive stains on an item or surface, such as, e.g., for example, a stain resulting from food, grass, blood, milk, or egg protein. Cleaning performance of a variant or reference protease can be determined by subjecting the stain on the item or surface to standard wash condition(s) and assessing the degree to which the stain is removed by using various chromatographic, spectrophotometric, or other quantitative methodologies. Exemplary cleaning assays and methods include, but are not limited to, e.g., those described in WO 99/34011 and U.S. Pat. No. 6,605,458, as well as those cleaning assays and methods included in the Examples presented below. Cleaning performance can be determined by comparing the subtilisin variant described herein to a reference subtilisin protease in various cleaning assays concerning enzyme sensitive stains, such as, for example, grass, blood, milk, ink or egg as determined by usual spectrophotometric or analytical methodologies after standard wash cycle conditions.

The "cleaning effective amount" of one or more subtilisin variant described herein or reference protease refers to the amount of protease that achieves a desired level of enzymatic activity in a specific cleaning composition. Such effective amounts are readily ascertained by one of ordinary skill in the art and are based on many factors, such as the particular protease used, the cleaning application, the specific composition of the cleaning composition, and whether a liquid or dry (e.g., granular, bar) composition is required, etc.

"Cleaning adjunct material" refers to any liquid, solid, or gaseous material included in a cleaning composition other than the one or more subtilisin variant described herein. In one embodiment, a cleaning composition comprises one or more subtilisin variant described herein and one or more cleaning adjunct material. Each cleaning adjunct material is typically selected depending on the particular type and form of cleaning composition (e.g., liquid, granule, powder, bar, paste, spray, tablet, gel; or foam composition). Preferably, each cleaning adjunct material is compatible with the one or more subtilisin variant described herein.

"Cleaning composition" refers to any composition useful for removing a compound (e.g., undesired compound) from an object, item or surface to be cleaned, including, but not limited, to, e.g., a fabric, fabric item, dishware item, tableware item, glassware item, contact lens, other solid substrate, hair (shampoo) (including human or animal hair), skin (soap or and cream), teeth (mouthwashes, toothpastes), surface of an item or object (e.g., hard surface, such as, e.g., the hard surface of a table, table top, wall, furniture item, floor, ceiling, non-dishware item, non-tableware item, etc.), contact lenses, etc. The term encompasses any material and/or added compound selected for the particular type of cleaning composition desired and the form of the product (e.g., liquid, gel, granule, or spray composition), as long as the composition is compatible with the protease and other enzyme(s) used in the composition. The specific selection of cleaning composition materials are readily made by considering the surface, object, item, or fabric to be cleaned, and the desired form of the composition. Cleaning compositions include compositions used in industrial and institutional as well as household cleaning.

Cleaning compositions include any composition that is suited for cleaning, bleaching, disinfecting, and/or sterilizing any object, item, and/or surface. Such compositions include, but are not limited to, for example, liquid and/or solid compositions (including cleaning or detergent compositions) such as, for example, liquid, tablet, gel, granule, unit dose and/or solid compositions; fine fabric detergent compositions; hard surface cleaning compositions, such as, for example, glass, wood, ceramic and metal counter tops and windows; carpet cleaners; oven cleaners; fabric fresheners; fabric softeners; laundry booster cleaning or detergent compositions; laundry additive cleaning compositions; laundry pre-spotter cleaning compositions; and dishwashing compositions, including hand or manual dishwashing compositions (e.g., "hand" or "manual" dishwashing detergents) and automatic dishwashing compositions (e.g., "automatic dishwashing detergents").

Cleaning compositions include, for example, granular or powder-form all-purpose or heavy-duty washing agents, especially cleaning detergents; liquid, granular, gel, solid, tablet, unit dose or paste-form all-purpose washing agents, especially the so-called heavy-duty liquid (HDL) detergent or heavy-duty powder detergent (HDD) types; liquid fine-fabric detergents; hand or manual dishwashing agents, including those of the high-foaming type; automatic dishwashing, or dishware or tableware washing agents, including the various tablet, powder, solid, granular, liquid, gel, and rinse-aid types for household and institutional use; liquid cleaning and disinfecting agents, including antibacterial hand-wash types, cleaning bars, mouthwashes, denture cleaners, car shampoos, carpet shampoos, bathroom cleaners; hair shampoos and/or hair-rinses for humans and other animals; shower gels and foam baths and metal cleaners; as well as cleaning auxiliaries, such as bleach additives and "stain-stick" or pre-treat types. In some embodiments, granular compositions are in "compact" form; in some embodiments, liquid compositions are in a "concentrated" form.

"Fabric cleaning compositions" refers to hand and machine laundry detergent compositions including laundry additive compositions and compositions suitable for use in the soaking and/or pretreatment of stained fabrics (e.g., clothes, linens, and other textile materials). Fabric cleaning compositions include composition used in industrial and institutional as well as household cleaning.

"Detergent composition" is used in reference to a composition intended for use in a wash medium for the cleaning of soiled or dirty objects.

"Bleaching" refers to the treatment of a material (e.g., fabric, laundry, pulp, etc.) or surface for a sufficient length of time and/or under appropriate pH and/or temperature conditions to effect a brightening (i.e., whitening) and/or cleaning of the material. Examples of chemicals suitable for bleaching include, but are not limited to, e.g., $ClO_2$, $H_2O_2$, peracids, $NO_2$, etc.

Disclosed herein is one or more subtilisin variant, including, e.g., but not limited to, serine protease variants and subtilisin protease variants, that are particularly well suited to and useful in a variety of cleaning applications. One embodiment is directed to one or more isolated, recombinant, substantially pure, and/or non-naturally occurring subtilisin variant. A further embodiment is directed to one or more subtilisin variant with enzymatic activity. In another embodiment the enzymatic activity is proteolytic activity. In a still further embodiment, the one or more subtilisin variant is a *Bacillus* sp. subtilisin variant.

Another embodiment provides an isolated subtilisin variant comprising an amino acid sequence comprising a combination of amino acid substitutions at two or more positions selected from: 78-X206A/D/F/G/H/M/N/P/R/S/Y, X78A/C/E/F/G/H/I/K/L/M/P/Q/R/T/V/W/Y-206, X78N-X206F/M/Y, X78G-X206D/F/H/M/N/P/R/Y, X78A/C/E/F/H/I/K/L/M/P/Q/R/T/V/W/Y-X206A/D/F/G/H/M/N/P/R/S/Y, 18-X78N, X18K/R-X78N, 18-X87R, X18K/R-X87R, 18-X206L/Y, X18K/R-X206L/Y, 24-X87R, X24F/L/P/R-X87R, 24-X206Y, X24F/L/P-206, X24F/L/P-X206Y, X24F/L/P-X209W, 40-78, X40E-78, 40-X78G, X40E-X78G, 40-87, X40E-87, 40-X87R, X40E-X87R, 40-129, 40-X129Q, X40E-129, X40E-X129Q, 40-130, 40-X130A, X40E-130, X40E-X130A, 40-206, X40E-206, 40-X206Y, X40E-X206Y, X78N-87, X78N-X87D/R, X78A/C/E/F/G/H/I/K/L/M/P/Q/R/T/V/W/Y-87, X78G-X87D/R/T, X78A/C/E/F/H/I/K/L/M/P/Q/R/T/V/W/Y-X87R, X78A/C/E/F/G/H/I/K/L/M/P/Q/R/T/V/W/Y-129, X78A/C/E/F/G/H/I/K/L/M/P/Q/R/T/V/W/Y-X129Q, X78A/C/E/F/H/I/K/L/M/P/Q/R/T/V/W/Y-X130A, X78G-X130A/Q, X78A/C/E/F/G/H/I/K/L/M/P/Q/R/T/V/W/Y-130, 78-X249N/R, X78N-249, X78N-X249N/R, 87-X206L/Y, X87D/R-X206L/Y, 87-X209W, X87D/R-X209W, 87-X213A, X87D/R-213, X87D/R-X213A, X87R-X249N/R, 129-X206Y, X129Q-X206Y, 129-X249N/R, X129Q-249, X129Q-X249N/R, 130-X206Y, X130A-X206R/Y, 130-X249N/R, X130A-249, X130A-X249N/R, X206Y-209, X206Y-X209W, 206-X213A, X206L/Y-213, X206L/Y-X213A, X206L/Y-249, X206L/Y-X249N/R, X209W-213, X209W-X213A, X209W-249, X209W-X249N/R, 18-24-78, X18K/R-24-78, 18-X24F/L/P/R-78, 18-24-X78N, X18K/R-24-X78N, 18-X24F/L/P/R-X78N, X18K/R-X24F/L/P/R-78, X18K/R-X24F/L/P/R-X78N, 18-24-87, X18K/R-24-87, 18-X24F/L/P/R-87, 18-24-X87D/R, X18K/R-24-X87D/R, 18-X24F/L/P/R-X87D/R, X18K/R-X24F/L/P/R-87, X18K/R-X24F/L/P/R-X87D/R, 18-24-129, X18K/R-24-129, 18-X24F/L/P/R-129, 18-24-X129Q, X18K/R-X24F/L/P/R-129, X18K/R-24-X129Q, 18-X24F/L/P/R-X129Q, X18K/R-X24F/L/P/R-X129Q, 18-24-130, 18-X24F/L/P/R-130, 18-24-X130A, X18K/R-24-130, X18K/R-X24F/L/P/R-130, X18K/R-24-X130A, 18-X24F/L/P/R-X130A, X18K/R-X24F/L/P/R-X130A, 18-24-206, 18-24-X206L/Y, 18-X24F/L/P/R-206, X18K/R-24-206, X18K/R-24-X206L/Y, 18-X24F/L/P/R-X206L/Y, X18K/R-X24F/L/P/R-206, X18K/R-X24F/L/P/R-X206L/Y, 18-24-209, 18-24-X209W, 18-X24F/L/P/R-209, X18K/R-24-209, X18K/R-24-X209W, 18-X24F/L/P/R-X209W, X18K/R-X24F/L/P/R-209, X18K/R-X24F/L/P/R-X209W, 18-78-87, 18-X78N-87, 18-78-X87D/R, X18K/R-78-87, X18K/R-X78N-87, X18K/R-78-X87D/R, 18-X78N-X87D/R, X18K/R-X78N-X87D/R, 18-78-129, 18-X78N-129, 18-78-X129Q, X18K/R-78-129, X18K/R-X78N-129, X18K/R-78-X129Q, 18-X78N-X129Q, X18K/R-X78N-X129Q, 18-78-130, 18-X78N-130, 18-78-X130A, X18K/R-78-130, X18K/R-X78N-130, X18K/R-78-X130A, 18-X78N-X130A, X18K/R-X78N-X130A, 18-78-206, 18-78-X206L/Y, 18-X78N-206, X18K/R-78-206, X18K/R-X206L/Y, X18K/R-X78N-206, X18K/R-78-X206L/Y, X18K/R-X78N-X206L/Y, 18-78-209, 18-X78N-209, 18-78-X209W, X18K/R-78-209, X18K/R-78-X209W, 18-X78N-X209W, X18K/R-X78N-209, X18K/R-X78N-X209W, 18-78-213, 18-X78N-213, 18-78-X213A, X18K/R-78-213, 18-X78N-X213A, X18K/R-X78N-213, X18K/R-78-X213A, X18K/R-X78N-X213A, 18-78-249, 18-78-X249N/R, 18-X78N-78-249, X18K/R-78-249, 18-X78N-X249N/R, X18K/R-X78N-249, X18K/R-78-X249N/R, X18K/R-X78N-X249, 18-87-129, X18K/R-87-129, 18-X87D/R-129, 18-87-X129Q, 18-X87D/R-X129Q, X18K/R-87-X129Q, X18K/R-X87D/R-129, X18K/R-X87D/R-X129Q, 18-87-130, X18K/R-87-130, 18-X87D/R-130, 18-87-X130A, 18-X87D/R-X130A, X18K/R-87-X130A, X18K/R-X87D/R-130, X18K/R-X87D/R-X130A, 18-87-206, X18K/R-87-206, 18-X87D/R-206, 18-87-X206L/Y, 18-X87D/R-X206L/Y, X18K/R-87-X206L/Y, X18K/R-X87D/R-206, X18K/R-X87D/R-X206L/Y, 18-87-209, X18K/R-87-209, 18-X87D/R-209, 18-87-X209W, 18-X87D/R-X209W, X18K/R-X87D/R-209, X18K/R-87-X209W, X18K/R-X87D/R-X209W, 18-X87D/R-213, 18-87-X213A, 18-X87D/R-X213A, X18K/R-X87D/R-213, X18K/R-87-X213A, X18K/R-X87D/R-X213A, 18-87-249, X18K/R-87-249, 18-X87D/R-249, 18-87-X249N/R, 18-X87D/R-249N/R, 18K/R-X87D/R-249, 18K/R-87-X249N/R, 18K/R-X87D/R-X249N/R, 18-129-130, X18K/R-129-130, 18-X129Q-130, 18-129-X130A, X129Q-130, X18K/R-129-X130A, 18-X129Q-X130A, X18K/R-X129Q-X130A, 18-129-206, X18K/R-129-206, 18-X129Q-206, 18-129-X206L/Y, X18K/R-X129Q-206, X18K/R-129-X206L/Y, 18-X129Q-X206L/Y, X18K/R-X129Q-X206L/Y, 18-129-209, X18K/R-129-209, 18-X129Q-209, 18-129-X209W, X18K/R-X129Q-209, X18K/R-129-X209W, 18-X129Q-X209W, X18K/R-X129Q-X209W, 18-129-213, X18K/R-129-213, 18-X129Q-213, 18-129-X213A, X18K/R-X129Q-213, X18K/R-129-X213A, 18-X129Q-X213A, X18K/R-X129Q-X213A, 18-129-249, X18K/R-129-249, 18-X129Q-249, 18-129-X249N/R, X18K/R-X129Q-249, X18K/R-129-X249N/R, 18-X129Q-X249N/R, X18K/R-X129Q-X249N/R, 18-130-206, X18K/R-130-206, 18-X130A-206, 18-130-X206L/Y, X18K/R-X130A-206, X18K/R-130-X206L/Y, 18-X130A-X206L/Y, X18K/R-X130A-X206L/Y, 18-130-209, X18K/R-130-209, 18-X130A-209, 18-130-X209W, X18K/R-X130A-209, X18K/R-130-X209W, 18-X130A-X209W, X18K/R-X130A-X209W, 18-130-213, X18K/R-130-213, 18-X130A-213, 18-130-X213A, X18K/R-X130A-213, X18K/R-130-X213A, 18-X130A-X213A, X18K/R-X130A-X213A, 18-130-249, X18K/R-130-249, 18-X130A-249, 18-130-X249N/R, X18K/R-X130A-249, X18K/R-130-X249N/R, 18-X130A-X249N/R, X18K/R-X130A-X249N/R, 18-206-209, 18-206-X209W, 18-X206L/Y-209, 18K/R-206-209, 18-X206L/Y-X209W, X18K/R-X206L/Y-209, X18K/R-206-X209W, X18K/R-X206L/Y-X209W, 18-206-213, X18K/R-206-213, 18-206L/Y-213, 18-206-X213A, X18K/R-X206L/Y-213, X18K/R-206-X213A, 18-X206L/Y-X213A, X18K/R-X206L/Y-X213A, 18-206-249, X18K/R-206-249, 18-206L/Y-249, 18-206-X249N/R, X18K/R-X206L/Y-249, X18K/R-206-X249N/R, 18-X206L/Y-X249N/R, X18K/R-X206L/Y-X249N/R, 18-209-213, 18-X209W-213, X18K/R-209-213, 18-209-X213A, 18-X209W-X213A, X18K/R-X209W-213, X18K/R-209-X213A, X18K/R-X209W-X213A, 18-209-249, 18-X209W-249, X18K/R-209-249, 18-209-X249N/R, 18-X209W-X249N/R, X18K/R-X209W-249, X18K/R-209-X249N/R, X18K/R-X209W-X249N/R, 18-213-X249N/R, X18K/R-X213A-249, X18K/R-213-X249N/R, 18-X213A-X249N/R, X18K/R-X213A-X249N/R, 24-78-87, 24-78-X87D/R, 24-X78N-87, X24F/L/P/R-78-87, 24-X78N-X87D/R, X24R/P/F-78-X87D/R, X24F/L/P/R-X78N-87, X24R/P/F-X78N-X87D/R, X24F/L/P-78-129, X24F/L/P-X78N-129, X24F/L/P-78-X129Q, X24F/L/P-X78N-X129Q, X24F/L/P-78-130, X24F/L/P-X78N-130, X24F/L/P-78-X130A, X24F/L/P-X78N-X130A, 24-78-X206Y, X24F/L/P-78-206, 24-X78N-X206Y, X24F/L/P-X78N-206, X24F/L/P-78-X206L/Y, X24F/L/P-X78N-X206L/Y, X24F/L/P-78-209, X24F/L/P-X78N-209, X24F/L/P-78-X209W, X24F/L/P-X78N-X209W, 24-78-213, X24F/L/P-R-78-213, 24-X78N-213, 24-78-X213A, X24F/L/P/R-X78N-213, X24F/L/P/R-78-X213A, 24-X78N-X213A, X24F/L/P/R-X78N-X213A, 24-78-X249N/R, 24-X78N-249, 24-X78N-X249N/R, X24F/L/P/R-X78N-249, X24F/L/P/R-78-X249N/R, X24F/L/P/R-X78N-X249N/R, 24-87-129, X24F/L/P/R-87-129, 24-X87D/R-129, 24-87-X129Q, X24F/L/P/R-X87D/R-129, X24F/L/P/R-87-X129Q, 24-X87D/R-X129Q, X24F/L/P/R-X87D/R-X129Q, 24-87-130, X24F/L/P/R-87-130, 24-X87D/R-130, 24-87-X130A, X24F/L/P/R-X87D/R-130, X24F/L/P/R-87-X130A, 24-X87D/R-X130A, X24F/L/P/R-X87D/R-X130A, 24-87-X206L/Y, 24-X87R-206, X24F/L/P/R-87-206, 24-X87D/R-X206L/Y, X24F/L/P/R-X87D/R-206, X24F/L/P/R-87-X206L/Y, X24F/L/P/R-X87D/R-X206L/Y, 24-87-X209W, X24F/L/P/R-87-X209W, 24-87-X209W, 24-87D/R-X209W, X24F/L/P/R-X87D/R-X209W, 24-X87D/R-213, 24-87-X213A, 24-X87D/R-X213A, X24F/L/P/R-X87D/R-213, X24F/L/P/R-87-X213A, X24F/L/P/R-X87D/R-X213A, 24-87-249, X24F/L/P/R-87-249, 24-X87D/R-249, 24-87-X249N/R, X24F/L/P/R-X87D/R-249, X24F/L/P/R-87-X249N/R, 24-X87D/R-X249N/R, X24F/L/P/R-X87D/R-X249N/R, X24F/L/P-129-130, X24F/L/P-X129Q-130, X24F/L/P-129-X130A, X24F/L/P-X129Q-X130A, X24F/L/P-129-206, 24-129-X206Y, X24F/L/P-X129Q-206, X24F/L/P-129-X206Y, 24-X129Q-X206Y, X24F/L/P-X129Q-X206L/Y, X24F/L/P/R-X129Q-X206Y, X24F/L/P-129-209, X24F/L/P-X129Q-209, X24F/L/P-129-X209W, X24F/L/P-X129Q-X209W, 24-129-213, X24F/L/P/R-129-213, 24-X129Q-213, 24-129-X213A, X24F/L/P/R-X129Q-213, X24F/L/P-129-X213A, 24-X129Q-X213A, X24F/L/P/R-X129Q-X213A, 24-129-249, X24F/L/P/R-129-249, 24-X129Q-249, 24-129-X249N/R, X24F/L/P/R-X129Q-249, X24F/L/P/R-129-X249N/R, 24-X129Q-X249N/R, X24F/L/P/R-X129Q-X249N/R, X24F/L/P-130-206, 24-130-X206Y, X24F/L/P-X130A-206, X24F/L/P-130-X206L/Y, X24F/L/P-130-X206Y, 24-X130A-X206Y, X24F/L/P-X130A-X206L/Y, X24F/L/P/R-X130A-X206Y, X24F/L/P-130-209, X24F/L/P-X130A-209, X24F/L/P-130-X209W, X24F/L/P-X130A-X209W, 24-130-213, X24F/L/P/R-130-213, 24-X130A-213, 24-130-X213A, X24F/L/P/R-X130A-213, X24F/L/P-130-X213A, 24-X130A-X213A, X24F/L/P/R-X130A-X213A, 24-130-249, X24F/L/P/R-130-249, 24-X130A-249, 24-130-X249N/R, X24F/L/P/R-X130A-249, X24F/L/P/R-130-X249N/R, 24-X130A-X249N/R, X24F/L/P/R-X130A-X249N/R, 24-X206Y-209, 24F/L/P-206-209, 24-X206Y-X209W, X24F/L/P-X206L/Y-209, X24F/L/P/R-X206Y-209, X24F/L/P-206-X209W, X24F/L/P-X206L/Y-X209W, X24F/L/P/R-X206Y-X209W, 24-206-213, X24F/L/P/R-206-213, 24-X206L/Y-213, 24-206-X213A, X24F/L/P/R-X206L/Y-213, X24F/L/P/R-206-X213A, 24-X206L/Y-X213A, X24F/L/P/R-X206L/Y-X213A, 24-206-249, 24-X206L/Y-249, X24F/L/P/R-206-249, 24-206-X249N/R, 24-X206L/Y-X249N/R, X24F/L/P/R-X206L/Y-249, X24F/L/P/R-206-X249N/R, X24F/L/P/R-X206L/Y-X249N/R, 24-209-213, 24-X209W-213, X24F/L/P/R-209-213, 24-209-X213A, X24F/L/P/R-X209W-213, 24-X209W-X213A, X24F/L/P/R-209-X213A, X24F/L/P/R-X209W-X213A, 24-209-249, 24-X209W-249, X24F/L/P/R-209-249, 24-209-X249N/R, X24F/L/P/R-X209W-249, X24F/L/P/R-209-X249N/R, X24F/L/P/R-209-X249N/R, X24F/

L/P/R-X209W-X249N/R, 78-87-129, X78N-87-129, 78-X87D/R-129, 78-87-X129Q, X78N-X87D/R-129, X78N-87-X129Q, 78-X87D/R-X129Q, X78N-X87D/R-X129Q, 78-87-130, X78N-87-130, 78-X87D/R-130, 78-87-X130A, X78N-X87D/R-130, X78N-87-X130A, 78-X87D/R-X130A, X78N-X87D/R-X130A, 78-87-206, 78-87-X206L/R/Y, X78N-87-206, 78-X87D/R-206, 78-X87D/R-X206L/R/Y, X78N-87-X206L/R/Y, X78N-X87D/R-206, X78N-X87D/R-X206L/R/Y, 78-87-209, 78-87-X209W, X78N-87-209, 78-X87D/R-209, X78N-X87D/R-209, 78-X87D/R-X209W, X78N-87-X209W, X78N-X87D/R-X209W, 78-87-213, X78N-87-213, 78-X87D/R-213, 78-87-X213A, X78N-X87D/R-213, X78N-87-X213A, 78-X87D/R-X213A, X78N-X87D/R-X213A, 78-87-249, 78-87-X249N/R, X78N-87-249, 78-87D/R-249, X78N-X87D/R-249, 78-X87D/R-X249N/R, X78N-87-X249N/R, X78N-X87D/R-X249N/R, 78-129-X206R/Y, X78N-129-X206Y, 78-X129Q-X206R/Y, X78N-X129Q-X206Y, 78-129-213, X78N-129-213, 78-X129Q-213, 78-129-X213A, X78N-X129Q-213, X78N-129-X213A, 78-X129Q-X213A, X78N-X129Q-X213A, 78-129-249, X78N-129-249, 78-X129Q-249, 78-129-X249N/R, X78N-X129Q-249, X78N-129-X249N/R, 78-X129Q-X249N/R, X78N-X129Q-X249N/R, 78-130-X206R/Y, X78N-130-X206Y, 78-X130A-X206R/Y, X78N-X130A-X206Y, 78-130-213, X78N-130-213, 78-X130A-213, 78-130-X213A, X78N-X130A-213, X78N-130-X213A, 78-X130A-X213A, X78N-X130A-X213A, 78-130-213, X78N-130-213, 78-X130A-213, 78-130-X213A, X78N-X130A-213, X78N-130-X213A, 78-X130A-X213A, X78N-X130A-X213A, 78-130-249, X78N-130-249, 78-X130A-249, 78-130-X249N/R, X78N-X130A-249, X78N-130-X249N/R, 78-X130A-X249N/R, X78N-X130A-X249N/R, 78-206-209, X78N-206-209, 78-X206L/Y-209, 78-206-X209W, X78N-X206L/Y-209, X78N-206-X209W, 78-X206L/Y-X209W, X78N-X206L/Y-X209W, 78-206-213, X78N-206-213, 78-X206L/Y-213, 78-206-X213A, X78N-X206L/Y-213, X78N-206-X213A, 78-X206L/Y-X213A, X78N-X206L/Y-X213A, 78-206-249, 78-206-X249R/N, 78-X206L/Y-249, X78N-206-249, X78N-206-X249N/R, 78-X206L/Y-X249N/R, X78N-X206L/Y-249, X78N-X206L/Y-X249N/R, 78-209-213, 78-X209W-213, 78-209-X213A, X78N-209-213, X78N-X209W-213, X78N-209-X213A, 78-X209W-X213A, X78N-X209W-X213A, 78-209-249, 78-X209W-249, 78-209-X249N/R, X78N-209-249, 78-X209W-X249N/R, X78N-X209W-249, X78N-209-X249N/R, X78N-X209W-X249N/R, 78-213-249, 78-X213A-249, X78N-213-249, 78-213-X249N/R, X78N-X213A-249, X78N-213-X249N/R, 78-X213A-X249N/R, X78N-X213A-X249N/R, 87-129-130, X87D/R-129-130, 87-X129Q-130, 87-129-X130A, X87D/R-X129Q-130, X87D/R-129-X130A, 87-X129Q-X130A, X87D/R-X129Q-X130A, 87-129-206, X87D/R-129-206, 87-X129Q-206, 87-129-X206L/R/Y, X87D/R-X129Q-206, X87D/R-129-X206L/R/Y, 87-X129Q-X206L/R/Y, X87D/R-X129Q-X206L/R/Y, 87-129-209, X87D/R-129-209, 87-X129Q-209, 87-129-X209W, X87D/R-X129Q-209, X87D/R-129-X209W, 87-X129Q-X209W, X87D/R-X129Q-X209W, 87-129-213, X87D/R-129-213, 87-X129Q-213, 87-129-X213A, X87D/R-X129Q-213, X87D/R-129-X213A, 87-X129Q-X213A, X87D/R-X129Q-X213A, 87-129-249, X87D/R-129-249, 87-X129Q-249, 87-129-X249N/R, X87D/R-X129Q-249, X87D/R-129-X249N/R, 87-X129Q-X249N/R, X87D/R-X129Q-X249N/R, 87-130-206, X87D/R-130-206, 87-X130A-206, 87-130-X206L/R/Y, X87D/R-X130A-206, X87D/R-130-X206L/R/Y, 87-X130A-X206L/R/Y, X87D/R-X130A-X206L/R/Y, 87-130-209, X87D/R-130-209, 87-X130A-209, 87-130-X209W, X87D/R-X130A-209, X87D/R-130-X209W, 87-X130A-X209W, X87D/R-X130A-X209W, 87-130-213, X87D/R-130-213, 87-X130A-213, 87-130-X213A, X87D/R-X130A-213, X87D/R-130-X213A, 87-X130A-X213A, X87D/R-X130A-X213A, 87-130-249, X87D/R-130-249, 87-X130A-249, 87-130-X249N/R, X87D/R-X130A-249, X87D/R-130-X249N/R, 87-X130A-X249N/R, X87D/R-X130A-X249N/R, 87-206-209, X87D/R-206-209, 87-X206L/Y-209, 87-206-X209W, X87D/R-X206L/Y-209, X87D/R-206-X209W, 87-X206L/Y-X209W, X87D/R-X206L/Y-X209W, 87-206-213, 87-X206L/Y-213, 87-206-X213A, X87D/R-206-213, X87D/R-X206L/Y-213, X87D/R-206-X213A, 87-X206L/Y-X213A, X87D/R-X206L/Y-X213A, 87-206-249, 87-X206L/Y-249, 87D/R-206-249, 87-209-X249N/R, X87R-206-X249N/R, X87D/R-X206L/Y-249, 87-X206L/Y-X249N/R, X87R-X206L/Y-X249N/R, 87-209-213, X87D/R-209-213, 87-X209W-213, 87-209-X213A, X87D/R-X209W-213, X87D/R-209-X213A, 87-X209W-X213A, X87D/R-X209W-X213A, 87-209-249, 87-X209W-249, 87-209-X249N/R, X87D/R-209-249, X87D/R-X209W-249, 87-X209W-X249N/R, X87R-209-X249N/R, X87D/R-X209W-X249N/R, 87-213-249, 87-X213A-249, X87D/R-213-249, 87-213-X249N/R, X87D/R-X213A-249, X87D/R-213-X249N/R, 87-X213A-X249N/R, X87D/R-X213A-X249N/R, 129-130-X206R/Y, X129Q-130-X206R/Y, 129-X130A-X206R/Y, X129Q-X130A-X206R/Y, 129-130-213, X129Q-130-213, 129-X130A-213, 129-130-X213A, X129Q-X130A-213, X129Q-130-X213A, 129-X130A-X213A, X129Q-X130A-X213A, 129-130-249, X129Q-130-249, 129-X130A-249, 129-130-X249N/R, X129Q-X130A-249, X129Q-130-X249N/R, 129-X130A-X249N/R, X129Q-X130A-X249N/R, 129-X206Y-209, X129Q-X206Y-209, 129-X206Y-X209W, X129Q-X206Y-X209W, 129-206-213, 129-X206L/Y-213, 129-206-X213A, X129Q-206-213, X129Q-X206L/Y-213, X129Q-206-X213A, 129-X206L/Y-X213A, X129Q-X206L/Y-X213A, 129-206-249, 129-X206L/Y-249, 129-206-X249N/R, X129Q-206-249, X129A-X206L/Y-249, X129Q-206-X249N/R, 129-X206L/Y-X249N/R, X129Q-X206L/Y-X249N/R, 129-209-213, 129-X209W-213, 129-209-X213A, X129Q-209-213, X129Q-X209W-213, X129Q-209-X213A, 129-X209W-X213A, X129Q-X209W-X213A, 129-209-249, 129-X209W-249, 129-209-X249N/R, X129Q-209-249, X129Q-X209W-249, X129Q-209-X249N/R, 129-X209W-X249N/R, X129Q-X209W-X249N/R, 129-213-249, 129-X213A-249, 129-213-X249N/R, X129Q-213-249, X129Q-X213A-249, 129-X213A-X249R, X129Q-213-X249N/R, X129Q-X213A-X249N/R, 130-X206Y-209, X130A-X206Y-209, 130-X206Y-X209W, X130A-X206Y-X209W, 130-206-213, 130-X206L/Y-213, 130-206-X213A, X130A-206-213, X130A-X206L/Y-213, X130A-206-X213A, 130-X206L/Y-X213A, X130A-X206L/Y-X213A, 130-206-249, 130-X206L/Y-249, 130-206-X249N/R, X130A-206-249, X130A-X206L/Y-249, X130A-206-X249N/R, 130-X206L/Y-X249N/R, X130A-X206L/Y-X249N/R, 130-209-213, 130-X209W-213, 130-209-X213A, X130A-209-213, X130A-X209W-213, X130A-209-X213A, 130-X209W-X213A, X130A-X209W-X213A, 130-209-249, 130-X209W-249, 130-209-X249N/R, X130A-209-249, X130A-X209W-249, X130A-209-X249N/R, 130-X209W-X249N/R, X130A-X209W-X249N/R, 130-213-249, 130-X213A-249, 130-213-X249N/R, X130A-213-249, X130A-X213A-249, 130-X213A-X249R, X130A-213-X249N/R, X130A-X213A-X249N/R, 130-209-249, 130-209-X249N/R, X130A-209-249, X130A-X209W-249, X130A-209-X249N/R, 130-X209W-X249N/R, X130A-

X209W-X249N/R, 206-209-213, 206-X209W-213, 206-209-X213A, X206L/Y-209-213, 206-X209W-X213A, X206L/Y-X209-213, X206L/Y-209-X213A, X206L/Y-X209W-X213A, 206-209-249, 206-X209W-249, 206-209-X249N/R, X206L/Y-209-249, X206L/Y-X209W-249, 206-X209W-X249N/R, X206L/Y-209-X249N/R, X206L/Y-X209W-X249N/R, 206-213-249, 206-X213A-249, 206-213-X249N/R X206L/Y-213-249, X206L/Y-X213A-249, X206L/Y-213-X249N/R, 206-X213A-X249N/R, X206L/Y-X213A-X249N/R, 209-213-249, X209W-213-249, 209-X213A-249, 209-213-X249N/R, X209W-X213A-249, X209W-213-X249N/R, 209-X213A-X249N/R, X209W-X213A-X249N/R, and combinations thereof, wherein X is any amino acid and said variant has proteolytic activity; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. A further embodiment provides an isolated subtilisin variant comprising an amino acid sequence comprising a combination of amino acid substitutions at two or more positions selected from: 78-X206A/D/F/G/H/M/N/P/R/S/Y, X78A/C/E/F/G/H/I/K/L/M/P/Q/R/T/V/W/Y-206, X78N-X206F/M/Y, X78G-X206D/F/H/M/N/P/R/Y, X78A/C/E/F/H/I/K/L/M/P/Q/R/T/V/W/Y-X206A/D/F/G/H/M/N/P/R/S/Y, 18-X78N, X18K/R-X78N, 18-X87R, X18K/R-X87R, 18-X206L/Y, X18K/R-X206L/Y, 24-X87R, X24F/L/P/R-X87R, 24-X206Y, X24F/L/P-206, X24F/L/P-X206Y, X24F/L/P-X209W, 40-78, X40E-78, 40-X78G, X40E-X78G, 40-87, X40E-87, 40-X87R, X40E-X87R, 40-129, 40-X129Q, X40E-129, X40E-X129Q, 40-130, 40-X130A, X40E-130, X40E-X130A, 40-206, X40E-206, 40-X206Y, X40E-X206Y, X78N-87, X78N-X87D/R, X78A/C/E/F/G/H/I/K/L/M/P/Q/R/T/V/W/Y-87, X78G-X87D/R/T, X78A/C/E/F/H/I/K/L/M/P/Q/R/T/V/W/Y-X87R, X78A/C/E/F/G/H/I/K/L/M/P/Q/R/T/V/W/Y-129, X78A/C/E/F/G/H/I/K/L/M/P/Q/R/T/V/W/Y-X129Q, X78A/C/E/F/H/I/K/L/M/P/Q/R/T/V/W/Y-X130A, X78G-X130A/Q, X78A/C/E/F/G/H/I/K/L/M/P/Q/R/T/V/W/Y-130, 78-X249N/R, X78N-249, X78N-X249N/R, 87-X206L/Y, X87D/R-X206L/Y, 87-X209W, X87D/R-X209W, 87-X213A, X87D/R-213, X87D/R-X213A, X87R-X249N/R, 129-X206Y, X129Q-X206Y, 129-X249N/R, X129Q-249, X129Q-X249N/R, 130-X206Y, X130A-X206R/Y, 130-X249N/R, X130A-249, X130A-X249N/R, X206Y-209, X206Y-X209W, 206-X213A, X206L/Y-213, X206L/Y-X213A, X206L/Y-249, X206L/Y-X249N/R, X209W-213, X209W-X213A, X209W-249, X209W-X249N/R, 18-24-78, X18K/R-24-78, 18-X24F/L/P/R-78, 18-24-X78N, X18K/R-24-X78N, 18-X24F/L/P/R-X78N, X18K/R-X24F/L/P/R-78, X18K/R-X24F/L/P/R-X78N, 18-24-87, X18K/R-24-87, 18-X24F/L/P/R-87, 18-24-X87D/R, X18K/R-24-X87D/R, 18-X24F/L/P/R-X87D/R, X18K/R-X24F/L/P/R-87, X18K/R-X24F/L/P/R-X87D/R, 18-24-129, X18K/R-24-129, 18-X24F/L/P/R-129, 18-24-X129Q, X18K/R-X24F/L/P/R-129, X18K/R-24-X129Q, 18-X24F/L/P/R-X129Q, X18K/R-X24F/L/P/R-X129Q, 18-24-130, 18-X24F/L/P/R-130, 18-24-X130A, X18K/R-24-130, X18K/R-X24F/L/P/R-130, X18K/R-24-X130A, 18-X24F/L/P/R-X130A, X18K/R-X24F/L/P/R-X130A, 18-24-206, 18-24-X206L/Y, 18-X24F/L/P/R-206, X18K/R-24-206, X18K/R-24-X206L/Y, 18-X24F/L/P/R-X206L/Y, X18K/R-X24F/L/P/R-206, X18K/R-X24F/L/P/R-X206L/Y, 18-24-209, 18-24-X209W, 18-X24F/L/P/R-209, X18K/R-24-209, X18K/R-24-X209W, 18-X24F/L/P/R-X209W, X18K/R-X24F/L/P/R-209, X18K/R-X24F/L/P/R-X209W, 18-78-87, 18-X78N-87, 18-78-X87D/R, X18K/R-78-87, X18K/R-X78N-87, X18K/R-78-X87D/R, 18-X78N-X87D/R, X18K/R-X78N-X87D/R, 18-78-129, 18-X78N-129, 18-78-X129Q, X18K/R-78-129, X18K/R-X78N-129, X18K/R-78-X129Q, 18-X78N-X129Q, X18K/R-X78N-X129Q, 18-78-130, 18-X78N-130, 18-78-X130A, X18K/R-78-130, X18K/R-X78N-130, X18K/R-78-X130A, 18-X78N-X130A, X18K/R-X78N-X130A, 18-78-206, 18-78-X206L/Y, 18-X78N-206, X18K/R-78-206, 18-X78N-X206L/Y, X18K/R-X78N-206, X18K/R-78-X206L/Y, X18K/R-X78N-X206L/Y, 18-78-209, 18-X78N-209, 18-78-X209W, X18K/R-78-209, X18K/R-78-X209W, 18-X78N-X209W, X18K/R-X78N-209, X18K/R-X78N-X209W, 18-78-213, 18-X78N-213, 18-78-X213A, X18K/R-78-213, 18-X78N-X213A, X18K/R-X78N-213, X18K/R-78-X213A, X18K/R-X78N-X213A, 18-78-249, 18-78-X249N/R, 18-X78N-249, X18K/R-78-249, 18-X78N-X249N/R, X18K/R-X78N-249, X18K/R-78-X249N/R, X18K/R-X78N-X249N/R, 18-87-129, X18K/R-87-129, 18-X87D/R-129, 18-87-X129Q, 18-X87D/R-X129Q, X18K/R-87-X129Q, X18K/R-X87D/R-129, X18K/R-X87D/R-X129Q, 18-87-130, X18K/R-87-130, 18-X87D/R-130, 18-87-X130A, 18-X87D/R-X130A, X18K/R-87-X130A, X18K/R-X87D/R-130, X18K/R-X87D/R-X130A, 18-87-206, X18K/R-87-206, 18-X87D/R-206, 18-87-X206L/Y, 18-X87D/R-X206L/Y, X18K/R-87-X206L/Y, X18K/R-X87D/R-206, X18K/R-X87D/R-X206L/Y, 18-87-209, X18K/R-87-209, 18-X87D/R-209, 18-87-X209W, 18-X87D/R-X209W, X18K/R-X87D/R-209, X18K/R-87-X209W, X18K/R-X87D/R-X209W, 18-X87D/R-213, 18-87-X213A, 18-X87D/R-X213A, X18K/R-X87D/R-213, X18K/R-87-X213A, X18K/R-X87D/R-X213A, 18-87-249, X18K/R-87-249, 18-X87D/R-249, 18-87-X249N/R, 18-X87D/R-X249N/R, X18K/R-X87D/R-249, X18K/R-87-X249N/R, X18K/R-X87D/R-X249N/R, 18-129-130, X18K/R-129-130, 18-X129Q-130, 18-129-X130A, X18K/R-X129Q-130, X18K/R-129-X130A, 18-X129Q-X130A, X18K/R-X129Q-X130A, 18-129-206, X18K/R-129-206, 18-X129Q-206, 18-129-X206L/Y, X18K/R-X129Q-206, X18K/R-129-X206L/Y, 18-X129Q-X206L/Y, X18K/R-X129Q-X206L/Y, 18-129-209, X18K/R-129-209, 18-X129Q-209, 18-129-X209W, X18K/R-X129Q-209, X18K/R-129-X209W, 18-X129Q-X209W, X18K/R-X129Q-X209W, 18-129-213, X18K/R-129-213, 18-X129Q-213, 18-129-X213A, X18K/R-X129Q-213, X18K/R-129-X213A, 18-X129Q-X213A, X18K/R-X129Q-X213A, 18-129-249, X18K/R-129-249, 18-X129Q-249, 18-129-X249N/R, X18K/R-X129Q-249, X18K/R-129-X249N/R, 18-X129Q-X249N/R, X18K/R-X129Q-X249N/R, 18-130-206, X18K/R-130-206, 18-X130A-206, 18-130-X206L/Y, X18K/R-X130A-206, X18K/R-130-X206L/Y, 18-X130A-X206L/Y, X18K/R-X130A-X206L/Y, 18-130-209, X18K/R-130-209, 18-X130A-209, 18-130-X209W, X18K/R-X130A-209, X18K/R-130-X209W, 18-X130A-X209W, X18K/R-X130A-X209W, 18-130-213, X18K/R-130-213, 18-X130A-213, 18-130-X213A, X18K/R-X130A-213, X18K/R-130-X213A, 18-X130A-X213A, X18K/R-X130A-X213A, 18-130-249, X18K/R-130-249, 18-X130A-249, 18-130-X249N/R, X18K/R-X130A-249, X18K/R-130-X249N/R, 18-X130A-X249N/R, X18K/R-X130A-X249N/R, 18-206-209, 18-206-X209W, 18-X206L/Y-209, X18K/R-206-209, 18-X206L/Y-X209W, X18K/R-X206L/Y-209, X18K/R-206-X209W, X18K/R-X206L/Y-X209W, 18-206-213, 18-X206L/Y-213, 18-206-X213A, X18K/R-X206L/Y-213, X18K/R-206-X213A, X18K/R-X206L/Y-X213A, X18K/R-X206L/Y-X213A, 18-206-249, X18K/R-206-249, 18-X206L/Y-249, 18-206-X249N/R, X18K/R-X206L/Y-249, X18K/R-206-X249N/R, 18-X206L/Y-

X249N/R, X18K/R-X206L/Y-X249N/R, 18-209-213, 18-X209W-213, X18K/R-209-213, 18-209-X213A, 18-X209W-X213A, X18K/R-X209W-213, X18K/R-209-X213A, X18K/R-X209W-X213A, 18-209-249, 18-X209W-249, X18K/R-209-249, 18-209-X249N/R, 18-X209W-X249N/R, 18K/R-X209W-249, X18K/R-209-X249N/R, X18K/R-X209W-X249N/R, 18-213-X249N/R, X18K/R-X213A-249, X18K/R-213-X249N/R, 18-X213A-X249N/R, X18K/R-X213A-X249N/R, 24-78-87, 24-78-X87D/R, 24-X78N-87, X24F/L/P/R-78-87, 24-X78N-X87D/R, X24R/P/F-78-X87D/R, X24F/L/P/R-X78N-87, X24R/P/F-X78N-X87D/R, X24F/L/P-78-129, X24F/L/P-X78N-129, X24F/L/P-78-X129Q, X24F/L/P-X78N-X129Q, X24F/L/P-78-130, X24F/L/P-X78N-130, X24F/L/P-78-X130A, X24F/L/P-X78N-X130A, 24-78-X206Y, X24F/L/P-78-206, 24-X78N-X206Y, X24F/L/P-X78N-206, X24F/L/P-78-X206L/Y, X24F/L/P-X78N-X206L/Y, X24F/L/P-78-209, X24F/L/P-X78N-209, X24F/L/P-78-X209W, X24F/L/P-X78N-X209W, 24-78-213, X24F/L/P/R-78-213, 24-X78N-213, 24-78-X213A, X24F/L/P/R-X78N-213, X24F/L/P/R-78-X213A, 24-X78N-X213A, X24F/L/P/R-X78N-X213A, 24-78-X249N/R, 24-X78N-249, 24-X78N-X249N/R, X24F/L/P/R-X78N-249, X24F/L/P/R-78-X249N/R, X24F/L/P/R-X78N-X249N/R, 24-87-129, X24F/L/P/R-87-129, 24-X87D/R-129, 24-87-X129Q, X24F/L/P/R-X87D/R-129, X24F/L/P/R-87-X129Q, 24-X87D/R-X129Q, X24F/L/P/R-X87D/R-X129Q, 24-87-130, X24F/L/P/R-87-130, 24-X87D/R-130, 24-87-X130A, X24F/L/P/R-X87D/R-130, X24F/L/P/R-87-X130A, 24-X87D/R-X130A, X24F/L/P/R-X87D/R-X130A, 24-87-X206L/Y, 24-X87R-206, X24F/L/P/R-87-206, 24-X87D/R-X206L/Y, X24F/L/P/R-X87D/R-206, X24F/L/P/R-87-X206L/Y, X24F/L/P/R-X87D/R-X206L/Y, 24-87-X209W, X24F/L/P/R-87-X209W, 24-87-X209W, 24-X87D/R-X209W, X24F/L/P/R-X87D/R-X209W, 24-X87D/R-213, 24-87-X213A, 24-X87D/R-X213A, X24F/L/P/R-X87D/R-213, X24F/L/P/R-87-X213A, X24F/L/P/R-X87D/R-X213A, 24-87-249, X24F/L/P/R-87-249, 24-X87D/R-249, 24-87-X249N/R, X24F/L/P/R-X87D/R-249, X24F/L/P/R-87-X249N/R, 24-X87D/R-X249N/R, X24F/L/P/R-X87D/R-X249N/R, X24F/L/P-129-130, X24F/L/P-X129Q-130, X24F/L/P-129-X130A, X24F/L/P-X129Q-X130A, X24F/L/P-129-206, 24-129-X206Y, X24F/L/P-X129Q-206, X24F/L/P-129-X206Y, 24-X129Q-X206Y, X24F/L/P-X129Q-X206L/Y, X24F/L/P-X129Q-X206Y, X24F/L/P-129-X209, X24F/L/P-X129Q-209, X24F/L/P-129-X209W, X24F/L/P-X129Q-X209W, 24-129-213, X24F/L/P-129-213, 24-X129Q-213, 24-129-X213A, X24F/L/P/R-X129Q-213, X24F/L/P-129-X213A, 24-X129Q-X213A, X24F/L/P/R-X129Q-X213A, 24-129-249, X24F/L/P/R-129-249, 24-X129Q-249, 24-129-X249N/R, X24F/L/P/R-X129Q-249, X24F/L/P/R-129-X249N/R, 24-X129Q-X249N/R, X24F/L/P/R-X129Q-X249N/R, X24F/L/P-130-206, 24-130-X206Y, X24F/L/P-X130A-206, X24F/L/P-130-X206L/Y, X24F/L/P/R-130-X206Y, 24-X130A-X206Y, X24F/L/P-X130A-X206L/Y, X24F/L/P/R-X130A-X206Y, X24F/L/P-130-209, X24F/L/P-X130A-209, X24F/L/P-130-X209W, X24F/L/P-X130A-X209W, 24-130-213, X24F/L/P/R-130-213, 24-X130A-213, 24-130-X213A, X24F/L/P/R-X130A-213, X24F/L/P/R-130-X213A, 24-X130A-X213A, X24F/L/P/R-X130A-X213A, 24-130-249, X24F/L/P/R-130-249, 24-X130A-249, 24-130-X249N/R, X24F/L/P/R-X130A-249, X24F/L/P/R-130-X249N/R, 24-X130A-X249N/R, X24F/L/P/R-X130A-X249N/R, 24-X206Y-209, X24F/L/P-206-209, 24-X206Y-X209W, X24F/L/P-X206L/Y-209, X24F/L/P-X206Y-209, X24F/L/P-206-X209W, X24F/L/P-X206L/Y-X209W, X24F/L/P-X206Y-X209W, 24-206-213, X24F/L/P-206-213, 24-X206L/Y-213, 24-206-X213A, X24F/L/P/R-X206L/Y-213, X24F/L/P/R-206-X213A, 24-X206L/Y-X213A, X24F/L/P/R-X206L/Y-X213A, 24-206-249, 24-X206L/Y-249, X24F/L/P/R-206-249, 24-206-X249N/R, 24-X206L/Y-X249N/R, X24F/L/P/R-X206L/Y-249, X24F/L/P/R-206-X249N/R, X24F/L/P/R-X206L/Y-X249N/R, 24-209-213, 24-X209W-213, X24F/L/P/R-209-213, 24-209-X213A, X24F/L/P/R-X209W-213, 24-X209W-X213A, X24F/L/P/R-209-X213A, X24F/L/P/R-X209W-X213A, 24-209-249, 24-X209W-249, X24F/L/P/R-209-249, 24-209-X249N/R, X24F/L/P/R-X209W-249, 24-X209W-X249N/R, X24F/L/P/R-209-X249N/R, X24F/L/P/R-X209W-X249N/R, 78-87-129, X78N-87-129, 78-X87D/R-129, 78-87-X129Q, X78N-X87D/R-129, X78N-87-X129Q, 78-X87D/R-X129Q, X78N-X87D/R-X129Q, 78-87-130, X78N-87-130, 78-X87D/R-130, 78-87-X130A, X78N-X87D/R-130, X78N-87-X130A, 78-X87D/R-X130A, X78N-X87D/R-X130A, 78-87-206, 78-87-X206L/R/Y, X78N-87-206, 78-X87D/R-206, 78-X87D/R-X206L/R/Y, X78N-87-X206L/R/Y, X78N-X87D/R-206, X78N-X87D/R-X206L/R/Y, 78-87-209, 78-87-X209W, X78N-87-209, 78-X87D/R-209, X78N-X87D/R-209, 78-X87D/R-X209W, X78N-87-X209W, X78N-X87D/R-X209W, 78-87-213, X78N-87-213, 78-X87D/R-213, 78-87-X213A, X78N-X87D/R-213, X78N-87-X213A, 78-X87D/R-X213A, X78N-X87D/R-X213A, 78-87-249, 78-87-X249N/R, X78N-87-249, 78-87D/R-249, X78N-X87D/R-249, 78-X87D/R-X249N/R, X78N-87-X249N/R, X78N-X87D/R-X249N/R, 78-129-X206R/Y, X78N-129-X206Y, 78-X129Q-X206R/Y, X78N-X129Q-X206Y, 78-129-213, X78N-129-213, 78-X129Q-213, 78-129-X213A, X78N-X129Q-213, X78N-129-X213A, 78-X129Q-X213A, X78N-X129Q-X213A, 78-129-249, X78N-129-249, 78-X129Q-249, 78-129-X249N/R, X78N-X129Q-249, X78N-129-X249N/R, 78-X129Q-X249N/R, X78N-X129Q-X249N/R, 78-130-X206R/Y, X78N-130-X206Y, 78-X130A-X206R/Y, X78N-X130A-X206Y, 78-130-213, X78N-130-213, 78-X130A-213, 78-130-X213A, X78N-X130A-213, X78N-130-X213A, 78-X130A-X213A, X78N-X130A-X213A, 78-130-213, X78N-130-213, 78-X130A-213, 78-130-X213A, X78N-X130A-213, X78N-130-X213A, 78-X130A-X213A, X78N-X130A-X213A, 78-130-249, X78N-130-249, 78-X130A-249, 78-130-X249N/R, X78N-X130A-249, X78N-130-X249N/R, 78-X130A-X249N/R, X78N-X130A-X249N/R, 78-206-209, X78N-206-209, 78-X206L/Y-209, 78-206-X209W, X78N-X206L/Y-209, X78N-206-X209W, 78-X206L/Y-X209W, X78N-X206L/Y-X209W, 78-206-213, X78N-206-213, 78-X206L/Y-213, 78-206-X213A, X78N-X206L/Y-213, 78-206-X213A, X78N-206-X213A, 78-X206L/Y-X213A, X78N-X206L/Y-X213A, 78-206-249, 78-206-X249R/N, 78-X206L/Y-249, X78N-206-249, X78N-206-X249N/R, 78-X206L/Y-X249N/R, X78N-X206L/Y-249, X78N-X206L/Y-X249N/R, 78-209-213, 78-X209W-213, 78-209-X213A, X78N-209-213, X78N-X209W-213, X78N-209-X213A, 78-X209W-X213A, X78N-X209W-X213A, 78-209-249, 78-X209W-249, 78-209-X249N/R, X78N-209-249, 78-X209W-X249N/R, X78N-X209W-249, X78N-209-X249N/R, X78N-X209W-X249N/R, 78-213-249, 78-X213A-249, X78N-213-249, 78-213-X249N/R, X78N-X213A-249, X78N-213-X249N/R, 78-X213A-X249N/R, X78N-X213A-X249N/R, 87-129-130, X87D/R-129-130, 87-129-X130A, 87-X129Q-130, X87D/R-X129Q-130, 87-X129Q-X130A, X87D/R-129-X130A, X87D/R-X129Q-X130A, 87-129-206, X87D/R-129-206, 87-X129Q-206, 87-129-X206L/R/Y, X87D/R-X129Q-206, X87D/R-129-X206L/R/Y, 87-X129Q-X206L/R/Y, X87D/R-X129Q-

X206L/R/Y, 87-129-209, X87D/R-129-209, 87-X129Q-209, 87-129-X209W, X87D/R-X129Q-209, X87D/R-129-X209W, 87-X129Q-X209W, X87D/R-X129Q-X209W, 87-129-213, X87D/R-129-213, 87-X129Q-213, 87-129-X213A, X87D/R-X129Q-213, X87D/R-129-X213A, 87-X129Q-X213A, X87D/R-X129Q-X213A, 87-129-249, X87D/R-129-249, 87-X129Q-249, 87-129-X249N/R, X87D/R-X129Q-249, X87D/R-129-X249N/R, 87-X129Q-X249N/R, X87D/R-X129Q-X249N/R, 87-130-206, X87D/R-130-206, 87-X130A-206, 87-130-X206L/R/Y, X87D/R-X130A-206, X87D/R-130-X206L/R/Y, 87-X130A-X206L/R/Y, X87D/R-X130A-X206L/R/Y, 87-130-209, X87D/R-130-209, 87-X130A-209, 87-130-X209W, X87D/R-X130A-209, X87D/R-130-X209W, 87-X130A-X209W, X87D/R-X130A-X209W, 87-130-213, X87D/R-130-213, 87-X130A-213, 87-130-X213A, X87D/R-X130A-213, X87D/R-130-X213A, 87-X130A-X213A, X87D/R-X130A-X213A, 87-130-249, X87D/R-130-249, 87-X130A-249, 87-130-X249N/R, X87D/R-X130A-249, X87D/R-130-X249N/R, 87-X130A-X249N/R, X87D/R-X130A-X249N/R, 87-206-209, X87D/R-206-209, 87-X206L/Y-209, 87-206-X209W, X87D/R-X206L/Y-209, X87D/R-206-X209W, 87-X206L/Y-X209W, X87D/R-X206L/Y-X209W, 87-206-213, 87-X206L/Y-213, 87-206-X213A, X87D/R-206-213, X87D/R-X206L/Y-213, X87D/R-206-X213A, 87-X206L/Y-X213A, X87D/R-X206L/Y-X213A, 87-206-249, 87-X206L/Y-249, X87D/R-206-249, 87-209-X249N/R, X87R-206-X249N/R, X87D/R-X206L/Y-249, 87-X206L/Y-X249N/R, X87R-X206L/Y-X249N/R, 87-209-213, X87D/R-209-213, 87-X209W-213, 87-209-X213A, X87D/R-X209W-213, X87D/R-209-X213A, 87-X209W-X213A, X87D/R-X209W-X213A, 87-209-249, 87-X209W-249, 87-209-X249N/R, X87D/R-209-249, X87D/R-X209W-249, 87-X209W-X249N/R, X87R-209-X249N/R, X87D/R-X209W-X249N/R, 87-213-249, 87-X213A-249, X87D/R-213-249, 87-213-X249N/R, X87D/R-X213A-249, X87D/R-213-X249N/R, 87-X213A-X249N/R, X87D/R-X213A-X249N/R, 129-130-X206R/Y, X129Q-130-X206R/Y, 129-X130A-X206R/Y, X129Q-X130A-X206R/Y, 129-130-213, X129Q-130-213, 129-X130A-213, 129-130-X213A, X129Q-X130A-213, X129Q-130-X213A, 129-X130A-X213A, X129Q-X130A-X213A, 129-130-249, X129Q-130-249, 129-X130A-249, 129-130-X249N/R, X129Q-X130A-249, X129Q-130-X249N/R, 129-X130A-X249N/R, X129Q-X130A-X249N/R, X129Q-X206Y-209, X129Q-X206Y-209, 129-X206Y-X209W, X129Q-X206Y-X209W, 129-206-213, 129-X206L/Y-213, 129-206-X213A, X129Q-206-213, X129Q-X206L/Y-213, X129Q-206-X213A, 129-X206L/Y-X213A, X129Q-X206L/Y-X213A, 129-206-249, 129-X206L/Y-249, 129-206-X249N/R, X129Q-206-249, X129A-X206L/Y-249, X129Q-206-X249N/R, X129Q-X206L/Y-X249N/R, 129-209-213, 129-X209W-213, 129-209-X213A, X129Q-209-213, X129Q-X209W-213, X129Q-209-X213A, 129-X209W-X213A, X129Q-X209W-X213A, 129-209-249, 129-X209W-249, 129-209-X249N/R, X129Q-209-249, X129Q-X209W-249, X129Q-209-X249N/R, 129-X209W-X249N/R, X129Q-X209W-X249N/R, 129-213-249, 129-X213A-249, 129-213-X249N/R, X129Q-213-249, X129Q-X213A-249, 129-X213A-X249R, X129Q-213-X249N/R, X129Q-X213A-X249N/R, 130-X206Y-209, X130A-X206Y-209, 130-X206Y-X209W, X130A-X206Y-X209W, 130-206-213, 130-X206L/Y-213, 130-206-X213A, X130A-206-213, X130A-X206L/Y-213, X130A-206-X213A, 130-X206L/Y-X213A, X130A-X206L/Y-X213A, 130-206-249, 130-X206L/Y-249, 130-206-X249N/R, X130A-206-249, X130A-X206L/Y-249, X130A-206-X249N/R, 130-X206L/Y-X249N/R, X130A-X206L/Y-X249N/R, 130-209-213, 130-X209W-213, 130-209-X213A, X130A-209-213, X130A-X209W-213, X130A-209-X213A, 130-X209W-X213A, X130A-X209W-X213A, 130-209-249, 130-X209W-249, 130-209-X249N/R, X130A-209-249, X130A-X209W-249, X130A-209-X249N/R, 130-X209W-X249N/R, X130A-X209W-X249N/R, 130-213-249, 130-X213A-249, 130-213-X249N/R, X130A-213-249, X130A-X213A-249, 130-X213A-X249R, X130A-213-X249N/R, X130A-X213A-X249N/R, 130-209-249, 130-X209W-249, 130-209-X249N/R, X130A-209-249, X130A-X209W-249, X130A-209-X249N/R, 130-X209W-X249N/R, X130A-X209W-X249N/R, 206-209-213, 206-X209W-213, 206-209-X213A, X206L/Y-209-213, 206-X209W-X213A, X206L/Y-X209W-213, X206L/Y-209-X213A, X206L/Y-X209W-X213A, 206-209-249, 206-X209W-249, 206-209-X249N/R, X206L/Y-209-249, X206L/Y-X209W-249, 206-X209W-X249N/R, X206L/Y-209-X249N/R, X206L/Y-X209W-X249N/R, 206-213-249, 206-X213A-249, 206-213-X249N/R X206L/Y-213-249, X206L/Y-X213A-249, X206L/Y-213-X249N/R, 206-X213A-X249N/R, X206L/Y-X213A-X249N/R, 209-213-249, X209W-213-249, 209-X213A-249, 209-213-X249N/R, X209W-X213A-249, X209W-213-X249N/R, 209-X213A-X249N/R, X209W-X213A-X249N/R, and combinations thereof, wherein X is any amino acid, said variant has proteolytic activity and the amino acid sequence of said variant further comprises one or more substitutions selected from: (i) 1, 3, 8, 9, 16, 20, 22, 28, 42, 43, 44, 56, 76, 77, 82, 88, 89, 99, 100, 101, 103, 104, 108, 116, 118, 120, 124, 127, 128, 147, 150, 158, 159, 160, 166, 185, 188, 194, 204, 210, 211, 212, 215, 216, 217, 218, 222, 232, 235, 241, 243, 245, 246, 248, 251, 252, 254, 256, 259, 261, 262, 268, 270, and 271; (ii) X1V, X3I/T/V, X8V, X9G, X16T, X20E/R, X22L/W, X28T, X42I, X43R/S/Y, X44V, X56P, X76D, X77D, X82D, X88S, X89H, X99N, X100S, X101F/G/H/Q/T/V, X103A/D/P, X104I, X108S, X116L/M, X118A/R/V, X120R, X124M, X127S/T, X128K/L/R, X147I, X150T, X158E/T/V, X159D, X160Q, X166D/N, X185Y, X188D, X194D/P, X204D, X210I/L, X211P, X212D, X215K/V, X216Y, X217K, X218S, X222L/Q/S, X232V, X235T, X241K, X243S, X245R, X246V, X248D, X251R, X252I, X254T, X256P, X259G, X261I/N, X262Q, X268A, X270P/T, and X271D; or (iii) A1V, S3I/T/V, I8V, S9G, A16T, G20E/R, T22L/W, V28T, L42I, N43R/S/Y, I44V, S56P, N76D, N77D, L82D, A88S, E89H, S99N, G100S, S101F/G/H/Q/T/V, S103A/D/P, V104I, A108S, N116L/M, G118A/R/V, H120R, L124M, G127S/T, S128K/LR, V147I, V150T, A158E/T/V, G159D, S160Q, S166D/N, N185Y, S188D, A194D/P, N204D, P210I/L, G211P, S212D, A215K/V, S216Y, L217K, N218S, M222L/Q/S, A232V, K235T, W241K, N243S, Q245R, I246V, N248D, K251R, N252I, A254T, S256P, S259G, N261I/N, L262Q, V268A, A270P/T, and E271D; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. An even still further embodiment provides an isolated subtilisin variant comprising an amino acid sequence comprising a combination of amino acid substitutions at two or more positions selected from: 78-X206A/D/F/G/H/M/N/P/R/S/Y, X78A/C/E/F/G/H/I/K/L/M/P/Q/R/T/V/W/Y-206, X78N-X206F/M/Y, X78G-X206D/F/H/M/N/P/R/Y, X78A/C/E/F/H/I/K/L/M/P/Q/R/T/V/W/Y-X206A/D/F/G/H/M/N/P/R/S/Y, 18-X78N, X18K/R-X78N, 18-X87R, X18K/R-X87R, 18-X206L/Y, X18K/R-X206L/Y, 24-X87R, X24F/L/P/R-X87R, 24-X206Y, X24F/L/P-206, X24F/L/P-X206Y, X24F/L/P-X209W, 40-78, X40E-78, 40-X78G, X40E-X78G, 40-87, X40E-87, 40-X87R, X40E-X87R, 40-129, 40-X129Q, X40E-129, X40E-X129Q, 40-130, 40-X130A, X40E-X130A, 40-206, X40E-206, 40-X206Y, X40E-X206Y, X78N-87, X78N-X87D/R, X78A/C/E/F/G/H/I/K/L/M/P/Q/R/T/V/W/Y-87, X78G-X87D/R/T, X78A/C/E/F/H/I/K/L/M/P/Q/R/T/V/W/Y-X87R, X78A/C/E/F/G/H/I/K/L/M/P/Q/R/T/V/W/Y-129, X78A/C/E/F/H/I/K/L/M/P/Q/R/T/V/W/Y-X129Q, X78A/C/E/F/H/I/K/L/M/P/Q/R/T/V/W/Y-X130A, X78G-X130A/Q, X78A/C/E/F/G/H/I/K/L/M/P/Q/R/T/V/W/Y-130, 78-X249N/R, X78N-249, X78N-X249N/R, 87-X206L/Y, X87D/R-X206L/Y, 87-X209W, X87D/R-X209W, 87-X213A, X87D/R-213, X87D/R-X213A, X87R-X249N/R, 129-X206Y, X129Q-X206Y, 129-X249N/R, X129Q-249, X129Q-X249N/R, 130-X206Y, X130A-X206R/Y, 130-X249N/R, X130A-249, X130A-X249N/R, X206Y-209, X206Y-X209W, 206-X213A, X206L/Y-213, X206L/Y-X213A, X206L/Y-249, X206L/Y-X249N/R, X209W-213, X209W-X213A, X209W-249, X209W-X249N/R, 18-24-78, X18K/R-24-78, 18-X24F/L/P/R-78, 18-24-X78N, X18K/R-24-X78N, 18-X24F/L/P/R-X78N, X18K/R-X24F/L/P/R-78, X18K/R-X24F/L/P/R-X78N, 18-24-87, X18K/R-24-87, 18-X24F/L/P/R-87, 18-24-X87D/R, X18K/R-24-X87D/R, 18-X24F/L/P/R-X87D/R, X18K/R-X24F/L/P/R-87, X18K/R-X24F/L/P/R-X87D/R, 18-24-129, X18K/R-24-129, 18-X24F/L/P/R-129, 18-24-X129Q, X18K/R-X24F/L/P/R-129, X18K/R-24-X129Q, 18-X24F/L/P/R-X129Q, X18K/R-X24F/L/P/R-X129Q, 18-24-130, 18-X24F/L/P/R-130, 18-24-X130A, X18K/R-24-130, X18K/R-X24F/L/P/R-130, X18K/R-24-X130A, 18-X24F/L/P/R-X130A, X18K/R-X24F/L/P/R-X130A, 18-24-206, 18-24-X206L/Y, 18-X24F/L/P/R-206, X18K/R-24-206, X18K/R-24-X206L/Y, 18-X24F/L/P/R-X206L/Y, X18K/R-X24F/L/P/R-206, X18K/R-X24F/L/P/R-X206L/Y, 18-24-209, 18-24-X209W, 18-X24F/L/P/R-209, X18K/R-24-209, X18K/R-24-X209W, 18-X24F/L/P/R-X209W, X18K/R-X24F/L/P/R-209, X18K/R-X24F/L/P/R-X209W, 18-78-87, 18-X78N-87, 18-78-X87D/R, X18K/R-78-87, X18K/R-X78N-87, X18K/R-78-X87D/R, 18-X78N-X87D/R, X18K/R-X78N-X87D/R, 18-78-129, 18-X78N-129, 18-78-X129Q, X18K/R-78-129, X18K/R-X78N-129, X18K/R-78-X129Q, 18-X78N-X129Q, X18K/R-X78N-X129Q, 18-78-130, 18-X78N-130, 18-78-X130A, X18K/R-78-130, X18K/R-X78N-130, X18K/R-78-X130A, 18-X78N-X130A, X18K/R-X78N-X130A, 18-78-206, 18-78-X206L/Y, 18-X78N-206, X18K/R-78-206, X18K/R-X78N-206, X18K/R-78-X206L/Y, X18K/R-X78N-X206L/Y, 18-78-209, 18-X78N-209, 18-78-X209W, X18K/R-78-209, X18K/R-78-X209W, 18-X78N-X209W, X18K/R-X78N-209, X18K/R-X78N-X209W, 18-78-213, 18-X78N-213, 18-78-X213A, X18K/R-78-213, 18-X78N-X213A, X18K/R-X78N-213, X18K/R-78-X213A, X18K/R-X78N-X213A, 18-78-249, 18-78-X249N/R, 18-X78N-249, X18K/R-78-249, 18-X78N-X249N/R, X18K/R-X78N-249, X18K/R-78-X249N/R, X18K/R-X78N-X249N/R, 18-87-129, X18K/R-87-129, 18-X87D/R-129, 18-87-X129Q, 18-X87D/R-X129Q, X18K/R-87-X129Q, X18K/R-X87D/R-129, X18K/R-X87D/R-X129Q, 18-87-130, X18K/R-87-130, 18-X87D/R-130, 18-87-X130A, 18-X87D/R-X130A, X18K/R-87-X130A, X18K/R-X87D/R-130, X18K/R-X87D/R-X130A, 18-87-206, X18K/R-87-206, 18-X87D/R-206, 18-87-X206L/Y, 18-X87D/R-X206L/Y, X18K/R-87-X206L/Y, X18K/R-X87D/R-206, X18K/R-X87D/R-X206L/Y, 18-87-209, X18K/R-87-209, 18-X87D/R-209, 18-87-X209W, 18-X87D/R-X209W, X18K/R-X87D/R-209, X18K/R-87-X209W, X18K/R-X87D/R-X209W, 18-X87D/R-213, 18-87-X213A, 18-X87D/R-X213A, X18K/R-X87D/R-213, X18K/R-87-X213A, X18K/R-X87D/R-X213A, 18-87-249, X18K/R-87-249, 18-X87D/R-249, 18-87-X249N/R, 18-X87D/R-X249N/R, X18K/R-X87D/R-249, X18K/R-87-X249N/R, X18K/R-X87D/R-X249N/R, 18-129-130, X18K/R-129-130, 18-X129Q-130, 18-129-X130A, X18K/R-X129Q-130, X18K/R-129-X130A, 18-X129Q-X130A, X18K/R-X129Q-X130A, 18-129-206, X18K/R-129-206, 18-X129Q-206, 18-129-X206L/Y, X18K/R-X129Q-206, X18K/R-129-X206L/Y, 18-X129Q-X206L/Y, X18K/R-X129Q-X206L/Y, 18-129-209, X18K/R-129-209, 18-X129Q-209, 18-129-X209W, X18K/R-X129Q-209, X18K/R-129-X209W, 18-X129Q-X209W, X18K/R-X129Q-X209W, 18-129-213, X18K/R-129-213, 18-X129Q-213, 18-129-X213A, X18K/R-X129Q-213, X18K/R-129-X213A, 18-X129Q-X213A, X18K/R-X129Q-X213A, 18-129-249, X18K/R-129-249, 18-X129Q-249, 18-129-X249N/R, X18K/R-X129Q-249, X18K/R-129-X249N/R, 18-X129Q-X249N/R, X18K/R-X129Q-X249N/R, 18-130-206, X18K/R-130-206, 18-X130A-206, 18-130-X206L/Y, X18K/R-X130A-206, X18K/R-130-X206L/Y, 18-X130A-X206L/Y, X18K/R-X130A-X206L/Y, 18-130-209, X18K/R-130-209, 18-X130A-209, 18-130-X209W, X18K/R-X130A-209, X18K/R-130-X209W, 18-X130A-X209W, X18K/R-X130A-X209W, 18-130-213, X18K/R-130-213, 18-X130A-213, 18-130-X213A, X18K/R-X130A-213, X18K/R-130-X213A, 18-X130A-X213A, X18K/R-X130A-X213A, 18-130-249, X18K/R-130-249, 18-X130A-249, 18-130-X249N/R, X18K/R-X130A-249, X18K/R-130-X249N/R, 18-X130A-X249N/R, X18K/R-X130A-X249N/R, 18-206-209, 18-206-X209W, 18-X206L/Y-209, X18K/R-206-209, 18-X206L/Y-X209W, X18K/R-X206L/Y-209, X18K/R-206-X209W, X18K/R-X206L/Y-X209W, 18-206-213, X18K/R-206-213, 18-206L/Y-213, 18-206-X213A, X18K/R-X206L/Y-213, X18K/R-206-X213A, 18-X206L/Y-X213A, X18K/R-X206L/Y-X213A, 18-206-249, X18K/R-206-249, 18-206L/Y-249, 18-206-X249N/R, X18K/R-X206L/Y-249, X18K/R-206-X249N/R, 18-X206L/Y-X249N/R, X18K/R-X206L/Y-X249N/R, 18-209-213, 18-209W-213, X18K/R-209-213, 18-209-X213A, 18-X209W-X213A, X18K/R-X209W-213, X18K/R-209-X213A, X18K/R-X209W-X213A, 18-209-249, 18-X209W-249, X18K/R-209-249, 18-209-X249N/R, 18-X209W-X249N/R, X18K/R-X209W-249, X18K/R-209-X249N/R, X18K/R-209-X249N/R, X18K/R-X209W-X249N/R, 18-213-X249N/R, X18K/R-X213A-249, X18K/R-213-X249N/R, 18-X213A-X249N/R, X18K/R-X213A-X249N/R, 24-78-87, 24-78-X87D/R, 24-X78N-87, X24F/L/P/R-78-87, 24-X78N-X87D/R, X24R/P/F-78-X87D/R, X24F/L/P/R-X78N-87, X24R/P/F-X78N-X87D/R, X24F/L/P-78-129, X24F/L/P-X78N-129, X24F/L/P-78-X129Q, X24F/L/P-X78N-X129Q, X24F/L/P-78-130, X24F/L/P-X78N-130, X24F/L/P-78-X130A, X24F/L/P-X78N-X130A, 24-78-X206Y, X24F/L/P-78-206, 24-X78N-X206Y, X24F/L/P-X78N-206, X24F/L/P-78-X206L/Y, X24F/L/P-X78N-X206L/Y, X24F/L/P-78-209, X24F/L/P-X78N-209, X24F/L/P-78-X209W, X24F/L/P-X78N-X209W, 24-78-213, X24F/L/P-78-213, 24-X78N-213, 24-78-X213A, X24F/L/P-X78N-213, X24F/L/P-78-X213A, 24-X78N-X213A, X24F/L/P-X78N-X213A, 24-78-X249N/R, 24-X78N-249, 24-X78N-X249N/R, X24F/L/P-X78N-249, X24F/L/P-78-X249N/R, X24F/L/P-X78N-X249N/R, 24-87-129, X24F/L/P-87-129, 24-X87D/R-129, 24-87-X129Q, X24F/L/P-X87D/R-129, X24F/L/P-87-X129Q, 24-X87D/R-X129Q, X24F/L/P-X87D/R-X129Q, 24-87-130, X24F/L/P-87-130, 24-X87D/R-130, 24-87-X130A, X24F/L/P-X87D/R-130, X24F/L/P/R-87-X130A, 24-X87D/R-X130A, X24F/L/P/R-X87D/R-X130A, 24-87-X206L/Y, 24-X87R-206, X24F/L/P/R-87-206, 24-X87D/R-X206L/Y, X24F/L/P/R-X87D/R-206, X24F/L/P/R-87-X206L/Y, X24F/L/P/R-X87D/R-X206L/Y, 24-87-X209W, X24F/L/P/R-87-X209W, 24-87-X209W, 24-X87D/R-X209W, X24F/L/P/R-X87D/R-X209W, 24-X87D/R-213, 24-87-X213A, 24-X87D/R-X213A, X24F/L/P/R-X87D/R-213, X24F/L/P/R-87-X213A, X24F/L/P/R-X87D/R-X213A, 24-87-249, X24F/L/P/R-87-249, 24-X87D/R-249, 24-87-X249N/R, X24F/L/P/R-X87D/R-249, X24F/L/P/R-87-X249N/R, 24-X87D/R-X249N/R, X24F/L/P/R-X87D/R-X249N/R, X24F/L/P-129-130, X24F/L/P-X129Q-130, X24F/L/P-129-X130A, X24F/L/P-X129Q-X130A, X24F/L/P-129-206, 24-129-X206Y, X24F/L/P-X129Q-206, X24F/L/P-129-X206Y, 24-X129Q-X206Y, X24F/L/P-X129Q-X206L/Y, X24F/L/P/R-X129Q-X206Y, X24F/L/P-129-209, X24F/L/P-X129Q-209, X24F/L/P-129-X209W, X24F/L/P-X129Q-X209W, 24-129-213, X24F/L/P/R-129-213, 24-X129Q-213, 24-129-X213A, X24F/L/P/R-X129Q-213, X24F/L/P/R-129-X213A, 24-X129Q-X213A, X24F/L/P/R-X129Q-X213A, 24-129-249, X24F/L/P/R-129-249, 24-X129Q-249, 24-129-X249N/R, X24F/L/P/R-X129Q-249, X24F/L/P/R-129-X249N/R, 24-X129Q-X249N/R, X24F/L/P/R-X129Q-X249N/R, X24F/L/P-130-206, 24-130-X206Y, X24F/L/P-X130A-206, X24F/L/P-130-X206L/Y, X24F/L/P/R-130-X206Y, 24-X130A-X206Y, X24F/L/P-X130A-X206L/Y, X24F/L/P/R-X130A-X206Y, X24F/L/P-130-209, X24F/L/P-X130A-209, X24F/L/P-130-X209W, X24F/L/P-X130A-X209W, 24-130-213, X24F/L/P/R-130-213, 24-X130A-213, 24-130-X213A, X24F/L/P/R-X130A-213, X24F/L/P/R-130-X213A, 24-X130A-X213A, X24F/L/P/R-X130A-X213A, 24-130-249, X24F/L/P/R-130-249, 24-X130A-249, 24-130-X249N/R, X24F/L/P/R-X130A-249, X24F/L/P/R-130-X249N/R, 24-X130A-X249N/R, X24F/L/P/R-X130A-X249N/R, 24-X206Y-209, 24F/L/P-206-209, 24-X206Y-X209W, X24F/L/P-X206L/Y-209, X24F/L/P/R-X206Y-209, X24F/L/P-206-X209W, X24F/L/P-X206L/Y-X209W, X24F/L/P/R-X206Y-X209W, 24-206-213, X24F/L/P/R-206-213, 24-X206L/Y-213, 24-206-X213A, X24F/L/P/R-X206L/Y-213, X24F/L/P/R-206-X213A, 24-X206L/Y-X213A, X24F/L/P/R-X206L/Y-X213A, 24-206-249, 24-X206L/Y-249, X24F/L/P/R-206-249, 24-206-X249N/R, 24-X206L/Y-X249N/R, X24F/L/P/R-X206L/Y-249, X24F/L/P/R-206-X249N/R, X24F/L/P/R-X206L/Y-X249N/R, 24-209-213, 24-X209W-213, X24F/L/P/R-209-213, 24-209-X213A, X24F/L/P/R-X209W-213, 24-X209W-X213A, X24F/L/P/R-209-X213A, X24F/L/P/R-X209W-X213A, 24-209-249, 24-X209W-249, X24F/L/P/R-209-249, 24-209-X249N/R, X24F/L/P/R-X209W-249, 24-X209W-X249N/R, X24F/L/P/R-209-X249N/R, X24F/L/P/R-X209W-X249N/R, 78-87-129, X78N-87-129, 78-X87D/R-129, 78-87-X129Q, X78N-X87D/R-129, X78N-87-X129Q, 78-X87D/R-X129Q, X78N-X87D/R-X129Q, 78-87-130, X78N-87-130, 78-X87D/R-130, 78-87-X130A, X78N-X87D/R-130, X78N-87-X130A, 78-X87D/R-X130A, X78N-X87D/R-X130A, 78-87-206, 78-87-X206L/R/Y, X78N-87-206, 78-X87D/R-206, 78-X87D/R-X206L/R/Y, X78N-87-X206L/R/Y, X78N-X87D/R-206, X78N-X87D/R-X206L/R/Y, 78-87-209, 78-87-X209W, X78N-87-209, 78-X87D/R-209, X78N-X87D/R-209, 78-X87D/R-X209W, X78N-87-X209W, X78N-X87D/R-X209W, 78-87-213, X78N-87-213, 78-X87D/R-213, 78-87-X213A, X78N-X87D/R-213, X78N-87-X213A, 78-X87D/R-X213A, X78N-X87D/R-X213A, 78-87-249, 78-87-X249N/R, X78N-87-249, 78-X87D/R-249, X78N-X87D/R-249, X78N-87-X249N/R, X78N-X87D/R-X249N/R, 78-129-X206R/Y, X78N-129-X206Y, 78-X129Q-X206R/Y, X78N-X129Q-X206Y, 78-129-213, X78N-129-213, 78-X129Q-213, 78-129-X213A, X78N-X129Q-213, X78N-129-X213A, 78-X129Q-X213A, X78N-X129Q-X213A, 78-129-249, X78N-129-249, 78-X129Q-249, 78-129-X249N/R, X78N-X129Q-249, X78N-129-X249N/R, 78-X129Q-X249N/R, X78N-X129Q-X249N/R, 78-130-X206R/Y, X78N-130-X206Y, 78-X130A-X206R/Y, X78N-X130A-X206Y, 78-130-213, X78N-130-213, 78-X130A-213, 78-130-X213A, X78N-X130A-213, X78N-130-X213A, 78-X130A-X213A, X78N-X130A-X213A, 78-130-213, X78N-130-213, 78-X130A-213, 78-130-X213A, X78N-X130A-213, X78N-130-X213A, 78-X130A-X213A, X78N-X130A-X213A, 78-130-249, X78N-130-249, 78-X130A-249, 78-130-X249N/R, X78N-X130A-249, X78N-130-X249N/R, 78-X130A-X249N/R, X78N-X130A-X249N/R, 78-206-209, X78N-206-209, 78-X206L/Y-209, 78-206-X209W, X78N-X206L/Y-209, X78N-206-X209W, 78-X206L/Y-X209W, X78N-X206L/Y-X209W, 78-206-213, X78N-206-213, 78-X206L/Y-213, 78-206-X213A, X78N-X206L/Y-213, X78N-206-X213A, 78-X206L/Y-X213A, X78N-X206L/Y-X213A, 78-206-249, 78-206-X249R/N, 78-X206L/Y-249, X78N-206-249, X78N-206-X249N/R, 78-X206L/Y-X249N/R, X78N-X206L/Y-249, X78N-X206L/Y-X249N/R, 78-209-213, 78-X209W-213, 78-209-X213A, X78N-209-213, X78N-X209W-213, X78N-209-X213A, 78-X209W-X213A, X78N-X209W-X213A, 78-209-249, 78-X209W-249, 78-209-X249N/R, X78N-209-249, 78-X209W-X249N/R, X78N-X209W-249, X78N-209-X249N/R, X78N-X209W-X249N/R, 78-213-249, 78-X213A-249, X78N-213-249, 78-213-X249N/R, X78N-X213A-249, X78N-213-X249N/R, 78-X213A-X249N/R, X78N-X213A-X249N/R, 87-129-130, X87D/R-129-130, 87-X129Q-130, 87-129-X130A, X87D/R-X129Q-130, X87D/R-129-X130A, 87-X129Q-X130A, X87D/R-X129Q-X130A, 87-129-206, X87D/R-129-206, 87-X129Q-206, 87-129-X206L/R/Y, X87D/R-X129Q-206, X87D/R-129-X206L/R/Y, 87-X129Q-X206L/R/Y, X87D/R-X129Q-X206L/R/Y, 87-129-209, X87D/R-129-209, 87-X129Q-209, 87-129-X209W, X87D/R-X129Q-209, X87D/R-129-X209W, 87-X129Q-X209W, X87D/R-X129Q-X209W, 87-129-213, X87D/R-129-213, 87-X129Q-213, 87-129-X213A, X87D/R-X129Q-213, X87D/R-129-X213A, 87-X129Q-X213A, X87D/R-X129Q-X213A, 87-129-249, X87D/R-129-249, 87-X129Q-249, 87-129-X249N/R, X87D/R-X129Q-249, X87D/R-129-X249N/R, 87-X129Q-X249N/R, X87D/R-X129Q-X249N/R, 87-130-206, X87D/R-130-206, 87-X130A-206, 87-130-X206L/R/Y, X87D/R-X130A-206, X87D/R-130-X206L/R/Y, 87-X130A-X206L/R/Y, X87D/R-X130A-X206L/R/Y, 87-130-209, X87D/R-130-209, 87-X130A-209, 87-130-X209W, X87D/R-X130A-209, X87D/R-130-X209W, 87-X130A-X209W, X87D/R-X130A-X209W, 87-130-213, X87D/R-130-213, 87-X130A-213, 87-130-X213A, X87D/R-X130A-213, X87D/R-130-X213A, 87-X130A-X213A, X87D/R-X130A-X213A, 87-130-249, X87D/R-130-249, 87-X130A-249, 87-130-X249N/R, X87D/R-X130A-249, X87D/R-130-X249N/R, 87-X130A-X249N/R, X87D/R-X130A-X249N/R, 87-206-209, X87D/R-206-209, 87-X206L/Y-209, 87-206-X209W, X87D/R-X206L/Y-209, X87D/R-206-X209W, 87-X206L/Y-X209W, X87D/R-X206L/Y-X209W, 87-206-213, X87D/R-X206L/Y-213, 87-206-X213A, X87D/R-206-213, X87D/R-206-X213A, 87-X206L/Y-X213A, X87D/R-X206L/Y-X213A, 87-206-249, 87-X206L/Y-249, 87D/R-206-249, 87-209-X249N/R, X87R-206-X249N/R, X87D/R-X206L/Y-249, 87-X206L/

Y-X249N/R, X87R-X206L/Y-X249N/R, 87-209-213, X87D/R-209-213, 87-X209W-213, 87-209-X213A, X87D/R-X209W-213, X87D/R-209-X213A, 87-X209W-X213A, X87D/R-X209W-X213A, 87-209-249, 87-X209W-249, 87-209-X249N/R, X87D/R-209-249, X87D/R-X209W-249, 87-X209W-X249N/R, X87R-209-X249N/R, X87D/R-X209W-X249N/R, 87-213-249, 87-X213A-249, X87D/R-213-249, 87-213-X249N/R, X87D/R-X213A-249, X87D/R-213-X249N/R, 87-X213A-X249N/R, X87D/R-X213A-X249N/R, 129-130-X206R/Y, X129Q-130-X206R/Y, 129-X130A-X206R/Y, X129Q-X130A-X206R/Y, 129-130-213, X129Q-130-213, 129-X130A-213, 129-130-X213A, X129Q-X130A-213, X129Q-130-X213A, 129-X130A-X213A, X129Q-X130A-X213A, 129-130-249, X129Q-130-249, 129-X130A-249, 129-130-X249N/R, X129Q-X130A-249, X129Q-130-X249N/R, 129-X130A-X249N/R, X129Q-X130A-X249N/R, 129-X206Y-209, X129Q-X206Y-209, 129-X206Y-X209W, X129Q-X206Y-X209W, 129-206-213, 129-X206L/Y-213, 129-206-X213A, X129Q-206-213, X129Q-X206L/Y-213, X129Q-206-X213A, 129-X206L/Y-X213A, X129Q-X206L/Y-X213A, 129-206-249, 129-X206L/Y-249, 129-206-X249N/R, X129Q-206-249, X129A-X206L/Y-249, X129Q-206-X249N/R, 129-X206L/Y-X249N/R, X129Q-X206L/Y-X249N/R, 129-209-213, 129-X209W-213, 129-209-X213A, X129Q-209-213, X129Q-X209W-213, X129Q-209-X213A, 129-X209W-X213A, X129Q-X209W-X213A, 129-209-249, 129-X209W-249, 129-209-X249N/R, X129Q-209-249, X129Q-X209W-249, X129Q-209-X249N/R, 129-X209W-X249N/R, X129Q-X209W-X249N/R, 129-213-249, 129-X213A-249, 129-213-X249N/R, X129Q-213-249, X129Q-X213A-249, 129-X213A-X249R, X129Q-213-X249N/R, X129Q-X213A-X249N/R, 130-X206Y-209, X130A-X206Y-209, 130-X206Y-X209W, X130A-X206Y-X209W, 130-206-213, 130-X206L/Y-213, 130-206-X213A, X130A-206-213, X130A-X206L/Y-213, X130A-206-X213A, 130-X206L/Y-X213A, X130A-X206L/Y-X213A, 130-206-249, 130-X206L/Y-249, 130-206-X249N/R, X130A-206-249, X130A-X206L/Y-249, X130A-206-X249N/R, 130-X206L/Y-X249N/R, X130A-X206L/Y-X249N/R, 130-209-213, 130-X209W-213, 130-209-X213A, X130A-209-213, X130A-X209W-213, X130A-209-X213A, 130-X209W-X213A, X130A-X209W-X213A, 130-209-249, 130-X209W-249, 130-209-X249N/R, X130A-209-249, X130A-X209W-249, X130A-209-X249N/R, 130-X209W-X249N/R, X130A-X209W-X249N/R, 130-213-249, 130-X213A-249, 130-213-X249N/R, X130A-213-249, X130A-X213A-249, 130-X213A-X249R, X130A-213-X249N/R, X130A-X213A-X249N/R, 130-209-249, 130-X209W-249, 130-209-X249N/R, X130A-209-249, X130A-X209W-249, X130A-209-X249N/R, 130-X209W-X249N/R, X130A-X209W-X249N/R, 206-209-213, 206-X209W-213, 206-209-X213A, X206L/Y-209-213, 206-X209W-X213A, X206L/Y-X209W-213, X206L/Y-209-X213A, X206L/Y-X209W-X213A, 206-209-249, 206-X209W-249, 206-209-X249N/R, X206L/Y-209-249, X206L/Y-X209W-249, X206L/Y-X209W-X249N/R, X206L/Y-209-X249N/R, X206L/Y-X209W-X249N/R, 206-213-249, 206-X213A-249, 206-213-X249N/R X206L/Y-213-249, X206L/Y-X213A-249, X206L/Y-213-X249N/R, 206-X213A-X249N/R, X206L/Y-X213A-X249N/R, 209-213-249, X209W-213-249, 209-X213A-249, 209-213-X249N/R, X209W-X213A-249, X209W-213-X249N/R, 209-X213A-X249N/R, and combinations thereof, wherein X is any amino acid, said variant has proteolytic activity and the amino acid sequence of said variant further comprises one or more substitutions selected from: (i) 3, 8, 22, 28, 43, 76, 89, 99, 101, 103, 104, 108, 116, 118, 124, 127, 128, 147, 150, 158, 159, 166, 188, 194, 210, 211, 212, 215, 217, 222, 232, 235, 243, 245, 246, 261, 262, 270, and 271; (ii) X3T/V, X8V, X22W, X28T, X43S, X76D, X89H, X99N, X101F/G/V, X103A/D/P, X104I, X108S, X116M, X118R, X124M, X127T, X128L, X147I, X150T, X158E/T, X159D, X166D, X188D, X194D/P, X210I/L, X211P, X212D, X215V, X217K, X222Q/S, X232V, X235T, X243S, X245R, X246V, X261I, X262Q, X270T, and X271D; or (iii) S3T/V, I8V, T22W, V28T, N43S, N76D, E89H, S99N, S101F/G/V, S103A/D/P, V104I, A108S, N116M, G118R, L124M, G127T, S128L, V147I, V150T, A158E/T, G159D, S166D, S188D, A194D/P, P210I/L, G211P, S212D, A215V, L217K, M222Q/S, A232V, K235T, N243S, Q245R, I246V, N261I, L262Q, A270T, and E271D; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. An even still further embodiment provides an isolated subtilisin variant comprising an amino acid sequence comprising a combination of amino acid substitutions at two or more positions selected from: 78-X206A/D/F/G/H/M/N/P/R/S/Y, X78A/C/E/F/G/H/I/K/L/M/P/Q/R/T/V/W/Y-206, X78N-X206F/M/Y, X78G-X206D/F/H/M/N/P/R/Y, X78A/C/E/F/H/I/K/L/M/P/Q/R/T/V/W/Y-X206A/D/F/G/H/M/N/P/R/S/Y, 18-X78N, X18K/R-X78N, 18-X87R, X18K/R-X87R, 18-X206L/Y, X18K/R-X206L/Y, 24-X87R, X24F/L/P-X87R, 24-X206Y, X24F/L/P-206, X24F/L/P-X206Y, X24F/L/P-X209W, 40-78, X40E-78, 40-X78G, X40E-X78G, 40-87, X40E-87, 40-X87R, X40E-X87R, 40-129, 40-X129Q, X40E-129, X40E-X129Q, 40-130, 40-X130A, X40E-130, X40E-X130A, 40-206, X40E-206, 40-X206Y, X40E-X206Y, X78N-87, X78N-X87D/R, X78A/C/E/F/G/H/I/K/L/M/P/Q/R/T/V/W/Y-87, X78G-X87D/R/T, X78A/C/E/F/H/I/K/L/M/P/Q/R/T/V/W/Y-X87R, X78A/C/E/F/G/H/I/K/L/M/P/Q/R/T/V/W/Y-129, X78A/C/E/F/G/H/I/K/L/M/P/Q/R/T/V/W/Y-X129Q, X78A/C/E/F/H/I/K/L/M/P/Q/R/T/V/W/Y-X130A, X78G-X130A/Q, X78A/C/E/F/G/H/I/K/L/M/P/Q/R/T/V/W/Y-130, 78-X249N/R, X78N-249, X78N-X249N/R, 87-X206L/Y, X87D/R-X206L/Y, 87-X209W, X87D/R-X209W, 87-X213A, X87D/R-213, X87D/R-X213A, 87-X249N/R, X87D/R-X249N/R, 129-X206Y, X129Q-X206Y, 129-X249N/R, X129Q-249, X129Q-X249N/R, 130-X206Y, X130A-X206R/Y, 130-X249N/R, X130A-249, X130A-X249N/R, X206Y-209, X206Y-X209W, 206-X213A, X206L/Y-213, X206L/Y-X213A, X206L/Y-249, X206L/Y-X249N/R, X209W-213, X209W-X213A, X209W-249, X209W-X249N/R, 18-24-78, X18K/R-24-78, 18-X24F/L/P-78, 18-24-X78N, X18K/R-24-X78N, 18-X24F/L/P-X78N, X18K/R-X24F/L/P-78, X18K/R-X24F/L/P-X78N, 18-24-87, X18K/R-24-87, 18-X24F/L/P-87, 18-24-X87D/R, X18K/R-24-X87D/R, 18-X24F/L/P-X87D/R, X18K/R-X24F/L/P-87, X18K/R-X24F/L/P-X87D/R, 18-24-129, X18K/R-24-129, 18-X24F/L/P-129, 18-24-X129Q, X18K/R-X24F/L/P-129, X18K/R-24-X129Q, 18-X24F/L/P-X129Q, X18K/R-X24F/L/P-X129Q, 18-24-130, 18-X24F/L/P-130, 18-24-X130A, X18K/R-24-130, X18K/R-X24F/L/P-130, X18K/R-24-X130A, 18-X24F/L/P-X130A, X18K/R-X24F/L/P-X130A, 18-24-206, 18-24-X206L/Y, 18-X24F/L/P-206, X18K/R-24-206, X18K/R-24-X206L/Y, 18-X24F/L/P-X206L/Y, X18K/R-X24F/L/P-206, X18K/R-X24F/L/P-X206L/Y, 18-24-209, 18-24-X209W, 18-X24F/L/P-209, X18K/R-24-209, X18K/R-24-X209W, 18-X24F/L/P-X209W, X18K/R-X24F/L/P-209, X18K/R-X24F/L/P-X209W, 18-78-87, 18-X78N-87, 18-78-X87D/R, X18K/R-78-87, X18K/R-X78N-87, X18K/R-78-X87D/R, 18-X78N-X87D/R, X18K/R-X78N-X87D/R, 18-78-129, 18-X78N-129, 18-78-X129Q, X18K/R-78-129, X18K/R-X78N-129, X18K/R-78-X129Q, 18-X78N-X129Q, X18K/R-X78N-X129Q, 18-78-130, 18-X78N-130, 18-78-X130A, X18K/R-78-130, X18K/R-X78N-130, X18K/R-78-X130A, 18-X78N-X130A, X18K/R-X78N-X130A, 18-78-206, 18-78-X206L/Y, 18-X78N-206, X18K/R-78-206, 18-X78N-X206L/Y, X18K/R-X78N-206, X18K/R-78-X206L/Y, X18K/R-X78N-X206L/Y, 18-78-209, 18-X78N-209, 18-78-X209W, X18K/R-78-209, X18K/R-78-X209W, 18-X78N-X209W, X18K/R-X78N-209, X18K/R-X78N-X209W, 18-78-213, 18-X78N-213, 18-78-X213A, X18K/R-78-213, 18-X78N-X213A, X18K/R-X78N-213, X18K/R-78-X213A, X18K/R-X78N-X213A, 18-78-249, 18-78-X249N/R, 18-X78N-249, X18K/R-78-249, 18-X78N-X249N/R, X18K/R-X78N-249, X18K/R-78-X249N/R, X18K/R-X78N-X249N/R, 18-87-129, X18K/R-87-129, 18-X87D/R-129, 18-87-X129Q, 18-X87D/R-X129Q, X18K/R-87-X129Q, X18K/R-X87D/R-129, X18K/R-X87D/R-X129Q, 18-87-130, X18K/R-87-130, 18-X87D/R-130, 18-87-X130A, 18-X87D/R-X130A, X18K/R-87-X130A, X18K/R-X87D/R-130, X18K/R-X87D/R-X130A, 18-87-206, X18K/R-87-206, 18-X87D/R-206, 18-87-X206L/Y, 18-X87D/R-X206L/Y, X18K/R-87-X206L/Y, X18K/R-X87D/R-206, X18K/R-X87D/R-X206L/Y, 18-87-209, X18K/R-87-209, 18-X87D/R-209, 18-87-X209W, 18-X87D/R-X209W, X18K/R-X87D/R-209, X18K/R-87-X209W, X18K/R-X87D/R-X209W, 18-X87D/R-213, 18-87-X213A, 18-X87D/R-X213A, X18K/R-X87D/R-213, X18K/R-87-X213A, X18K/R-X87D/R-X213A, 18-87-249, X18K/R-87-249, 18-X87D/R-249, 18-87-X249N/R, 18-X87D/R-249N/R, 18K/R-X87D/R-249, 18K/R-87-X249N/R, 18K/R-X87D/R-X249N/R, 18-129-130, X18K/R-129-130, 18-X129Q-130, 18-129-X130A, X18K/R-X129Q-130, X18K/R-129-X130A, 18-X129Q-X130A, X18K/R-X129Q-X130A, 18-129-206, X18K/R-129-206, 18-X129Q-206, 18-129-X206L/Y, X18K/R-X129Q-206, X18K/R-129-X206L/Y, 18-X129Q-X206L/Y, X18K/R-X129Q-X206L/Y, 18-129-209, X18K/R-129-209, 18-X129Q-209, 18-129-X209W, X18K/R-X129Q-209, X18K/R-129-X209W, 18-X129Q-X209W, X18K/R-X129Q-X209W, 18-129-213, X18K/R-129-213, 18-X129Q-213, 18-129-X213A, X18K/R-X129Q-213, X18K/R-129-X213A, 18-X129Q-X213A, X18K/R-X129Q-X213A, 18-129-249, X18K/R-129-249, 18-X129Q-249, 18-129-X249N/R, X18K/R-X129Q-249, X18K/R-129-X249N/R, 18-X129Q-X249N/R, X18K/R-X129Q-X249N/R, 18-130-206, X18K/R-130-206, 18-X130A-206, 18-130-X206L/Y, X18K/R-X130A-206, X18K/R-130-X206L/Y, 18-X130A-X206L/Y, X18K/R-X130A-X206L/Y, 18-130-209, X18K/R-130-209, 18-X130A-209, 18-130-X209W, X18K/R-X130A-209, X18K/R-130-X209W, 18-X130A-X209W, X18K/R-X130A-X209W, 18-130-213, X18K/R-130-213, 18-X130A-213, 18-130-X213A, X18K/R-X130A-213, X18K/R-130-X213A, 18-X130A-X213A, X18K/R-X130A-X213A, 18-130-249, X18K/R-130-249, 18-X130A-249, 18-130-X249N/R, X18K/R-X130A-249, X18K/R-130-X249N/R, 18-X130A-X249N/R, X18K/R-X130A-X249N/R, 18-206-209, 18-206-X209W, 18-X206L/Y-209, 18K/R-206-209, 18-X206L/Y-X209W, X18K/R-X206L/Y-209, X18K/R-206-X209W, X18K/R-X206L/Y-X209W, 18-206-213, 18-206-X213A, 18-X206L/Y-213, X18K/R-206-213, X18K/R-X206L/Y-213, X18K/R-206-X213A, 18-X206L/Y-X213A, X18K/R-X206L/Y-X213A, 18-206-249, X18K/R-206-249, 18-206-X249N/R, X18K/R-
X206L/Y-249, X18K/R-206-X249N/R, 18-X206L/Y-X249N/R, X18K/R-X206L/Y-X249N/R, 18-209-213, 18-X209W-213, X18K/R-209-213, 18-209-X213A, 18-X209W-X213A, X18K/R-X209W-213, X18K/R-209-X213A, X18K/R-X209W-X213A, 18-209-249, 18-X209W-249, X18K/R-209-249, 18-209-X249N/R, 18-X209W-X249N/R, 18K/R-X209W-249, X18K/R-209-X249N/R, X18K/R-X209W-X249N/R, 18-213-X249N/R, X18K/R-X213A-249, X18K/R-213-X249N/R, 18-X213A-X249N/R, X18K/R-X213A-X249N/R, 24-78-87, 24-78-X87D/R, 24-X78N-87, X24F/L/P-78-87, 24-X78N-X87D/R, X24R/P/F-78-X87D/R, X24F/L/P-R-X78N-87, X24R/P/F-X78N-X87D/R, X24F/L/P-78-129, X24F/L/P-X78N-129, X24F/L/P-78-X129Q, X24F/L/P-X78N-X129Q, X24F/L/P-78-130, X24F/L/P-X78N-130, X24F/L/P-78-X130A, X24F/L/P-X78N-X130A, 24-78-X206Y, X24F/L/P-78-206, 24-X78N-X206Y, X24F/L/P-X78N-206, X24F/L/P-78-X206L/Y, X24F/L/P-X78N-X206L/Y, X24F/L/P-78-209, X24F/L/P-X78N-209, X24F/L/P-78-X209W, X24F/L/P-X78N-X209W, 24-78-213, X24F/L/P-R-78-213, 24-X78N-213, 24-78-X213A, X24F/L/P/R-X78N-213, X24F/L/P-R-78-X213A, 24-X78N-X213A, X24F/L/P/R-X78N-X213A, 24-78-X249N/R, 24-X78N-249, 24-X78N-X249N/R, X24F/L/P-R-X78N-249, X24F/L/P-R-78-X249N/R, X24F/L/P-R-X78N-X249N/R, 24-87-129, X24F/L/P-R-87-129, 24-X87D/R-129, 24-87-X129Q, X24F/L/P-R-X87D/R-129, X24F/L/P-R-87-X129Q, 24-X87D/R-X129Q, X24F/L/P-R-X87D/R-X129Q, 24-87-130, X24F/L/P-R-87-130, 24-X87D/R-130, 24-87-X130A, X24F/L/P-R-X87D/R-130, X24F/L/P-R-87-X130A, 24-X87D/R-X130A, X24F/L/P-R-X87D/R-X130A, 24-87-X206L/Y, 24-X87R-206, X24F/L/P-R-87-206, 24-X87D/R-X206L/Y, X24F/L/P-R-X87D/R-206, X24F/L/P-R-87-X206L/Y, X24F/L/P-R-X87D/R-X206L/Y, 24-87-X209W, X24F/L/P-R-87-X209W, 24-87-X209W, 24-X87D/R-X209W, X24F/L/P-R-X87D/R-X209W, 24-X87D/R-213, 24-87-X213A, 24-X87D/R-X213A, X24F/L/P-R-X87D/R-213, X24F/L/P-R-87-X213A, X24F/L/P-R-X87D/R-X213A, 24-87-249, X24F/L/P-R-87-249, 24-X87D/R-249, 24-87-X249N/R, X24F/L/P-R-X87D/R-249, X24F/L/P-R-87-X249N/R, 24-X87D/R-X249N/R, X24F/L/P-R-X87D/R-X249N/R, X24F/L/P-129-130, X24F/L/P-X129Q-130, X24F/L/P-129-X130A, X24F/L/P-X129Q-X130A, X24F/L/P-129-206, 24-129-X206Y, X24F/L/P-X129Q-206, X24F/L/P-129-X206Y, 24-X129Q-X206Y, X24F/L/P-X129Q-X206L/Y, X24F/L/P-R-X129Q-X206Y, X24F/L/P-129-209, X24F/L/P-X129Q-209, X24F/L/P-129-X209W, X24F/L/P-X129Q-X209W, 24-129-213, X24F/L/P-R-129-213, 24-X129Q-213, 24-129-X213A, X24F/L/P-R-X129Q-213, X24F/L/P-R-129-X213A, 24-X129Q-X213A, X24F/L/P-R-X129Q-X213A, 24-129-249, X24F/L/P-R-129-249, 24-X129Q-249, 24-129-X249N/R, X24F/L/P-R-X129Q-249, X24F/L/P-R-129-X249N/R, 24-X129Q-X249N/R, X24F/L/P-R-X129Q-X249N/R, X24F/L/P-130-206, 24-130-X206Y, X24F/L/P-X130A-206, X24F/L/P-130-X206L/Y, X24F/L/P-130-X206Y, 24-X130A-X206Y, X24F/L/P-X130A-X206L/Y, X24F/L/P/R-X130A-X206Y, X24F/L/P-130-209, X24F/L/P-X130A-209, X24F/L/P-130-X209W, X24F/L/P-X130A-X209W, 24-130-213, X24F/L/P-R-130-213, 24-X130A-213, 24-130-X213A, X24F/L/P-R-X130A-213, X24F/L/P-R-130-X213A, 24-X130A-X213A, X24F/L/P-R-X130A-X213A, 24-130-249, X24F/L/P-R-130-249, 24-X130A-249, 24-130-X249N/R, X24F/L/P-R-X130A-249, X24F/L/P-R-130-X249N/R, 24-X130A-X249N/R, X24F/L/P-R-X130A-X249N/R, 24-X206Y-209, 24F/L/P-206-209, 24-X206Y-X209W, X24F/L/P-X206L/Y-209, X24F/L/P-R-X206Y-209, X24F/L/P-206-X209W, X24F/L/P-X206L/Y-X209W, X24F/L/P/R-X206Y-X209W, 24-206-213, X24F/L/P/R-206-213, 24-X206L/Y-213, 24-206-X213A, X24F/L/P/R-X206L/Y-213, X24F/L/P/R-206-X213A, 24-X206L/Y-X213A, X24F/L/P/R-X206L/Y-X213A, 24-206-249, 24-X206L/Y-249, X24F/L/P/R-206-249, 24-206-X249N/R, 24-X206L/Y-X249N/R, X24F/L/P/R-X206L/Y-249, X24F/L/P/R-206-X249N/R, X24F/L/P/R-X206L/Y-X249N/R, 24-209-213, 24-X209W-213, X24F/L/P/R-209-213, 24-209-X213A, X24F/L/P/R-X209W-213, X24F/L/P/R-209-X213A, X24F/L/P/R-X209W-X213A, 24-209-249, 24-X209W-249, X24F/L/P/R-209-249, 24-209-X249N/R, X24F/L/P/R-X209W-249, 24-X209W-X249N/R, X24F/L/P/R-209-X249N/R, X24F/L/P/R-X209W-X249N/R, 78-87-129, X78N-87-129, 78-X87D/R-129, 78-87-X129Q, X78N-X87D/R-129, X78N-87-X129Q, 78-X87D/R-X129Q, X78N-X87D/R-X129Q, 78-87-130, X78N-87-130, 78-X87D/R-130, 78-87-X130A, X78N-X87D/R-130, X78N-87-X130A, 78-X87D/R-X130A, X78N-X87D/R-X130A, 78-87-206, 78-87-X206L/R/Y, X78N-87-206, 78-X87D/R-206, 78-X87D/R-X206L/R/Y, X78N-87-X206L/R/Y, X78N-X87D/R-206, X78N-X87D/R-X206L/R/Y, 78-87-209, 78-87-X209W, X78N-87-209, 78-X87D/R-209, X78N-X87D/R-209, 78-X87D/R-X209W, X78N-87-X209W, X78N-X87D/R-X209W, 78-87-213, X78N-87-213, 78-X87D/R-213, 78-87-X213A, X78N-X87D/R-213, X78N-87-X213A, 78-X87D/R-X213A, X78N-X87D/R-X213A, 78-87-249, 78-87-X249N/R, X78N-87-249, 78-87D/R-249, X78N-X87D/R-249, 78-X87D/R-X249N/R, X78N-87-X249N/R, X78N-X87D/R-X249N/R, 78-129-X206R/Y, X78N-129-X206Y, 78-X129Q-X206R/Y, X78N-X129Q-X206Y, 78-129-213, X78N-129-213, 78-X129Q-213, 78-129-X213A, X78N-X129Q-213, X78N-129-X213A, 78-X129Q-X213A, X78N-X129Q-X213A, 78-129-249, X78N-129-249, 78-X129Q-249, 78-129-X249N/R, X78N-X129Q-249, X78N-129-X249N/R, 78-X129Q-X249N/R, X78N-X129Q-X249N/R, 78-130-X206R/Y, X78N-130-X206Y, 78-X130A-X206R/Y, X78N-X130A-X206Y, 78-130-213, X78N-130-213, 78-X130A-213, 78-130-X213A, X78N-X130A-213, X78N-130-X213A, 78-X130A-X213A, X78N-X130A-X213A, 78-130-213, X78N-130-213, 78-X130A-213, 78-130-X213A, X78N-X130A-213, X78N-130-X213A, 78-X130A-X213A, X78N-X130A-X213A, 78-130-249, X78N-130-249, 78-X130A-249, 78-130-X249N/R, X78N-X130A-249, X78N-130-X249N/R, 78-X130A-X249N/R, X78N-X130A-X249N/R, 78-206-209, X78N-206-209, 78-X206L/Y-209, 78-206-X209W, X78N-X206L/Y-209, X78N-206-X209W, 78-X206L/Y-X209W, X78N-X206L/Y-X209W, 78-206-213, X78N-206-213, 78-X206L/Y-213, 78-206-X213A, X78N-X206L/Y-213, X78N-206-X213A, 78-X206L/Y-X213A, X78N-X206L/Y-X213A, 78-206-249, 78-206-X249R/N, 78-X206L/Y-249, X78N-206-249, X78N-206-X249N/R, 78-X206L/Y-X249N/R, X78N-X206L/Y-249, X78N-X206L/Y-X249N/R, 78-209-213, 78-X209W-213, 78-209-X213A, X78N-209-213, X78N-X209W-213, X78N-209-X213A, 78-X209W-X213A, X78N-X209W-X213A, 78-209-249, 78-X209W-249, 78-209-X249N/R, X78N-X209W-249, 78-X209W-X249N/R, X78N-X209W-249, X78N-209-X249N/R, X78N-X209W-X249N/R, 78-213-249, 78-X213A-249, X78N-213-249, 78-213-X249N/R, X78N-X213A-249, X78N-213-X249N/R, 78-X213A-X249N/R, X78N-X213A-X249N/R, 87-129-130, X87D/R-129-130, 87-X129Q-130, 87-129-X130A, X87D/R-X129Q-130, X87D/R-129-X130A, 87-X129Q-X130A, X87D/R-X129Q-X130A, 87-129-206, X87D/R-129-206, 87-X129Q-206, 87-129-X206L/R/Y, X87D/R-X129Q-206, X87D/R-129-X206L/R/Y, 87-X129Q-X206L/R/Y, X87D/R-X129Q-X206L/R/Y, 87-129-209, X87D/R-129-209, 87-X129Q-209, 87-129-X209W, X87D/R-X129Q-209, X87D/R-129-X209W, 87-X129Q-X209W, X87D/R-X129Q-X209W, 87-129-213, X87D/R-129-213, 87-X129Q-213, 87-129-X213A, X87D/R-X129Q-213, X87D/R-129-X213A, 87-X129Q-X213A, X87D/R-X129Q-X213A, 87-129-249, X87D/R-129-249, 87-X129Q-249, 87-129-X249N/R, X87D/R-X129Q-249, X87D/R-129-X249N/R, 87-X129Q-X249N/R, X87D/R-X129Q-X249N/R, 87-130-206, X87D/R-130-206, 87-X130A-206, 87-130-X206L/R/Y, X87D/R-X130A-206, X87D/R-130-X206L/R/Y, 87-X130A-X206L/R/Y, X87D/R-X130A-X206L/R/Y, 87-130-209, X87D/R-130-209, 87-X130A-209, 87-130-X209W, X87D/R-X130A-209, X87D/R-130-X209W, 87-X130A-X209W, X87D/R-X130A-X209W, 87-130-213, X87D/R-130-213, 87-X130A-213, 87-130-X213A, X87D/R-X130A-213, X87D/R-130-X213A, 87-X130A-X213A, X87D/R-X130A-X213A, 87-130-249, X87D/R-130-249, 87-X130A-249, 87-130-X249N/R, X87D/R-X130A-249, X87D/R-130-X249N/R, 87-X130A-X249N/R, X87D/R-X130A-X249N/R, 87-206-209, X87D/R-206-209, 87-X206L/Y-209, 87-206-X209W, X87D/R-X206L/Y-209, X87D/R-206-X209W, 87-X206L/Y-X209W, X87D/R-X206L/Y-X209W, 87-206-213, 87-X206L/Y-213, 87-206-X213A, X87D/R-206-213, X87D/R-X206L/Y-213, X87D/R-206-X213A, 87-X206L/Y-X213A, X87D/R-X206L/Y-X213A, 87-206-249, 87-X206L/Y-249, 87D/R-206-249, 87-209-X249N/R, X87R-206-X249N/R, X87D/R-X206L/Y-249, 87-X206L/Y-X249N/R, X87R-X206L/Y-X249N/R, 87-209-213, X87D/R-209-213, 87-X209W-213, 87-209-X213A, X87D/R-X209W-213, X87D/R-209-X213A, 87-X209W-X213A, X87D/R-X209W-X213A, 87-209-249, 87-X209W-249, 87-209-X249N/R, X87D/R-209-249, X87D/R-X209W-249, 87-X209W-X249N/R, X87R-209-X249N/R, X87D/R-X209W-X249N/R, 87-213-249, 87-X213A-249, X87D/R-213-249, 87-213-X249N/R, X87D/R-X213A-249, X87D/R-213-X249N/R, 87-X213A-X249N/R, X87D/R-X213A-X249N/R, 129-130-X206R/Y, X129Q-130-X206R/Y, 129-X130A-X206R/Y, X129Q-X130A-X206R/Y, 129-130-213, X129Q-130-213, 129-X130A-213, 129-130-X213A, X129Q-X130A-213, X129Q-130-X213A, 129-X130A-X213A, X129Q-X130A-X213A, 129-130-249, X129Q-130-249, 129-X130A-249, 129-130-X249N/R, X129Q-X130A-249, X129Q-130-X249N/R, 129-X130A-X249N/R, X129Q-X130A-X249N/R, 129-X206Y-209, X129Q-X206Y-209, 129-X206Y-X209W, X129Q-X206Y-X209W, 129-206-213, 129-X206L/Y-213, 129-206-X213A, X129Q-206-213, X129Q-X206L/Y-213, X129Q-206-X213A, 129-X206L/Y-X213A, X129Q-X206L/Y-X213A, 129-206-249, 129-X206L/Y-249, 129-206-X249N/R, X129Q-206-249, X129A-X206L/Y-249, X129Q-206-X249N/R, 129-X206L/Y-X249N/R, X129Q-X206L/Y-X249N/R, 129-209-213, 129-X209W-213, 129-209-X213A, X129Q-209-213, X129Q-X209W-213, X129Q-209-X213A, 129-X209W-X213A, X129Q-X209W-X213A, 129-209-249, 129-X209W-249, 129-209-X249N/R, X129Q-209-249, X129Q-X209W-249, X129Q-209-X249N/R, 129-X209W-X249N/R, X129Q-X209W-X249N/R, 129-213-249, 129-X213A-249, 129-213-X249N/R, X129Q-213-249, X129Q-X213A-249, 129-X213A-X249R, X129Q-213-X249N/R, X129Q-X213A-X249N/R, 130-X206Y-209, X130A-X206Y-209, 130-X206Y-X209W, X130A-X206Y-X209W, 130-206-213, 130-X206L/Y-213, 130-206-X213A, X130A-206-213, X130A-X206L/Y-213, X130A-206-X213A, 130-X206L/Y-X213A, X130A-X206L/Y-X213A, 130-206-249, 130-X206L/Y-249, 130-206-X249N/R, X130A-206-249, X130A-X206L/Y-249, X130A-206-X249N/R, 130-X206L/ Y-X249N/R, X130A-X206L/Y-X249N/R, 130-209-213, 130-X209W-213, 130-209-X213A, X130A-209-213, X130A-X209W-213, X130A-209-X213A, 130-X209W-X213A, X130A-X209W-X213A, 130-209-249, 130-X209W-249, 130-209-X249N/R, X130A-209-249, X130A-X209W-249, X130A-209-X249N/R, 130-X209W-X249N/R, X130A-X209W-X249N/R, 130-213-249, 130-X213A-249, 130-213-X249N/R, X130A-213-249, X130A-X213A-249, 130-X213A-X249R, X130A-213-X249N/R, X130A-X213A-X249N/R, 130-209-249, 130-X209W-249, 130-209-X249N/R, X130A-209-249, X130A-X209W-249, X130A-209-X249N/R, 130-X209W-X249N/R, X130A-X209W-X249N/R, 206-209-213, 206-X209W-213, 206-209-X213A, X206L/Y-209-213, 206-X209W-X213A, X206L/Y-X209W-213, X206L/Y-209-X213A, X206L/Y-X209W-X213A, 206-209-249, 206-X209W-249, 206-209-X249N/R, X206L/Y-209-249, X206L/Y-X209W-249, 206-X209W-X249N/R, X206L/Y-209-X249N/R, X206L/Y-X209W-X249N/R, 206-213-249, 206-X213A-249, 206-213-X249N/R X206L/Y-213-249, X206L/Y-X213A-249, X206L/Y-213-X249N/R, 206-X213A-X249N/R, X206L/Y-X213A-X249N/R, 209-213-249, X209W-213-249, 209-X213A-249, 209-213-X249N/R, X209W-X213A-249, X209W-213-X249N/R, 209-X213A-X249N/R, X209W-X213A-X249N/R, and combinations thereof, wherein X is any amino acid, said variant has proteolytic activity and the amino acid sequence of said variant further comprises one or more substitutions selected from: (i) 1, 3, 8, 9, 16, 20, 22, 28, 42, 43, 44, 56, 76, 77, 82, 88, 100, 101, 103, 104, 108, 116, 118, 120, 124, 127, 128, 147, 150, 158, 159, 160, 166, 185, 194, 204, 210, 211, 212, 215, 216, 217, 218, 222, 232, 241, 245, 248, 251, 252, 254, 256, 259, 261, 262, 268, 270, 271; (ii) X1V, X3I/V, X8V, X9G, X16T, X20E/R, X22L/W, X28T, X42I, X43R/Y, X44V, X56P, X76D, X77D, X82D, X88S, X100S, X101G/H/Q/T/V, X103A, X104I, X108S, X116L/M, X118A/R/V, X120R, X124M, X127S/T, X128K/L/R, X147I, X150T, X158E/V, X160Q, X166D/N, X185Y, X194D/P, X204D, X210I, X211P, X212D, X215K/V, X216Y, X217K, X218S, X222Q/S, X232V, X241K, X245R, X248D, X251R, X252I, X254T, X256P, X259G, X261I, X262Q, X268A, X270P, and X271D; or (iii) A1V, S3I/V, I8V, S9G, A16T, G20E/R, T22L/W, V28T, L42I, N43R/Y, I44V, S56P, N76D, N77D, L82D, A88S, G100S, S101G/H/Q/T/V, S103A, V104I, A108S, N116L/M, G118A/R/V, H120R, L124M, G127S/T, S128K/LR, V147I, V150T, A158E/V, S160Q, S166D/N, N185Y, A194D/P, N204D, P210I, G211P, S212D, A215K/V, S216Y, L217K, N218S, M222Q/S, A232V, W241K, Q245R, N248D, K251R, N252I, A254T, S256P, S259G, N261I, L262Q, V268A, A270P, and E271D; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. An even still further embodiment provides an isolated subtilisin variant comprising an amino acid sequence comprising a combination of amino acid substitutions at two or more positions selected from: 78-X206A/D/F/G/H/M/N/P/R/S/Y, X78A/C/E/F/G/H/I/K/L/M/P/Q/R/T/V/W/Y-206, X78N-X206F/M/Y, X78G-X206D/F/H/M/N/P/R/Y, X78A/C/E/F/H/I/K/L/M/P/Q/R/T/V/W/Y-X206A/D/F/G/H/M/N/P/R/S/Y, 18-X78N, X18K/R-X78N, 18-X87R, X18K/R-X87R, 18-X206L/Y, X18K/R-X206L/Y, 24-X87R, X24F/L/P/R-X87R, 24-X206L/Y, X24F/L/P-206, X24F/L/P-X206Y, X24F/L/P-X209W, 40-78, X40E-78, 40-X78G, X40E-X78G, 40-87, X40E-87, 40-X87R, X40E-X87R, 40-129, 40-X129Q, X40E-129, X40E-X129Q, 40-130, 40-X130A, X40E-130, X40E-X130A, 40-206, X40E-206, 40-X206Y, X40E-X206Y, X78N-87, X78N-X87D/R, X78A/C/E/F/G/H/I/K/L/M/P/Q/R/T/V/W/Y-87, X78G-X87D/R/T, X78A/C/E/F/H/I/K/L/M/P/Q/R/T/V/W/Y-X87R, X78A/C/E/F/G/H/I/K/L/M/P/Q/R/T/V/W/Y-129, X78A/C/E/F/G/H/I/K/L/M/P/Q/R/T/V/W/Y-X129Q, X78A/C/E/F/H/I/K/L/M/P/Q/R/T/V/W/Y-X130A, X78G-X130A/Q, X78A/C/E/F/G/H/I/K/L/M/P/Q/R/T/V/W/Y-130, 78-X249N/R, X78N-249, X78N-X249N/R, 87-X206L/Y, X87D/R-X206L/Y, 87-X209W, X87D/R-X209W, 87-X213A, X87D/R-213, X87D/R-X213A, X87R-X249N/R, 129-X206Y, X129Q-X206Y, 129-X249N/R, X129Q-249, X129Q-X249N/R, 130-X206Y, X130A-X206R/Y, 130-X249N/R, X130A-249, X130A-X249N/R, X206Y-209, X206Y-X209W, 206-X213A, X206L/Y-213, X206L/Y-X213A, X206L/Y-249, X206L/Y-X249N/R, X209W-213, X209W-X213A, X209W-249, X209W-X249N/R, 18-24-78, X18K/R-24-78, 18-X24F/L/P/R-78, 18-24-X78N, X18K/R-24-X78N, 18-X24F/L/P/R-X78N, X18K/R-X24F/L/P/R-78, X18K/R-X24F/L/P/R-X78N, 18-24-87, X18K/R-24-87, 18-X24F/L/P/R-87, 18-24-X87D/R, X18K/R-24-X87D/R, 18-X24F/L/P/R-X87D/R, X18K/R-X24F/L/P/R-87, X18K/R-X24F/L/P/R-X87D/R, 18-24-129, X18K/R-24-129, 18-X24F/L/P/R-129, 18-24-X129Q, X18K/R-X24F/L/P/R-129, X18K/R-24-X129Q, 18-X24F/L/P/R-X129Q, X18K/R-X24F/L/P/R-X129Q, 18-24-130, 18-X24F/L/P/R-130, 18-24-X130A, X18K/R-24-130, X18K/R-X24F/L/P/R-130, X18K/R-24-X130A, 18-X24F/L/P/R-X130A, X18K/R-X24F/L/P/R-X130A, 18-24-206, 18-24-X206L/Y, 18-X24F/L/P/R-206, X18K/R-24-206, X18K/R-24-X206L/Y, 18-X24F/L/P/R-X206L/Y, X18K/R-X24F/L/P/R-206, X18K/R-X24F/L/P/R-X206L/Y, 18-24-209, 18-24-X209W, 18-X24F/L/P/R-209, X18K/R-24-209, X18K/R-24-X209W, 18-X24F/L/P/R-X209W, X18K/R-X24F/L/P/R-209, X18K/R-X24F/L/P/R-X209W, 18-78-87, 18-X78N-87, 18-78-X87D/R, X18K/R-78-87, X18K/R-X78N-87, X18K/R-78-X87D/R, 18-X78N-X87D/R, X18K/R-X78N-X87D/R, 18-78-129, 18-X78N-129, 18-78-X129Q, X18K/R-78-129, X18K/R-X78N-129, X18K/R-78-X129Q, 18-X78N-X129Q, X18K/R-X78N-X129Q, 18-78-130, 18-X78N-130, 18-78-X130A, X18K/R-78-130, X18K/R-X78N-130, X18K/R-78-X130A, 18-X78N-X130A, X18K/R-X78N-X130A, 18-78-206, 18-78-X206L/Y, 18-X78N-206, X18K/R-78-206, 18-X78N-X206L/Y, X18K/R-X78N-206, X18K/R-78-X206L/Y, X18K/R-X78N-X206L/Y, 18-78-209, 18-X78N-209, 18-78-X209W, X18K/R-78-209, X18K/R-78-X209W, 18-X78N-X209W, X18K/R-X78N-209, X18K/R-X78N-X209W, 18-78-213, 18-X78N-213, 18-78-X213A, X18K/R-78-213, 18-X78N-X213A, X18K/R-X78N-213, X18K/R-78-X213A, X18K/R-X78N-X213A, 18-78-249, 18-78-X249N/R, 18-X78N-249, X18K/R-78-249, 18-X78N-X249N/R, X18K/R-X78N-249, X18K/R-78-X249N/R, X18K/R-X78N-X249N/R, 18-87-129, X18K/R-87-129, 18-X87D/R-129, 18-87-X129Q, 18-X87D/R-X129Q, X18K/R-87-X129Q, X18K/R-X87D/R-129, X18K/R-X87D/R-X129Q, 18-87-130, X18K/R-87-130, 18-X87D/R-130, 18-87-X130A, 18-X87D/R-X130A, X18K/R-87-X130A, X18K/R-X87D/R-130, X18K/R-X87D/R-X130A, 18-87-206, X18K/R-87-206, 18-X87D/R-206, 18-87-X206L/Y, 18-X87D/R-X206L/Y, X18K/R-87-X206L/Y, X18K/R-X87D/R-206, X18K/R-X87D/R-X206L/Y, 18-87-209, X18K/R-87-209, 18-X87D/R-209, 18-87-X209W, 18-X87D/R-X209W, X18K/R-87-X209W, X18K/R-X87D/R-209, X18K/R-X87D/R-X209W, 18-87-213, 18-X87D/R-213, 18-87-X213A, 18-X87D/R-X213A, X18K/R-X87D/R-213, X18K/R-87-X213A, X18K/R-X87D/R-X213A, 18-87-249, X18K/R-87-249, 18-X87D/R-249, 18-87-X249N/R, 18-X87D/R-X249N/R, 18K/R-X87D/R-249, 18K/R-87-X249N/R, 18K/R-X87D/R-X249N/R, 18-129-130, X18K/R-129-130, 18-X129Q-130, 18-129-X130A, X18K/R-X129Q-130, X18K/R-129-X130A, 18-X129Q-X130A, X18K/R-X129Q-X130A, 18-129-206, X18K/R-129-206, 18-X129Q-206, 18-129-X206L/Y, X18K/R-X129Q-206, X18K/R-129-X206L/Y, 18-X129Q-X206L/Y, X18K/R-X129Q-X206L/Y, 18-129-209, X18K/R-129-209, 18-X129Q-209, 18-129-X209W, X18K/R-X129Q-209, X18K/R-129-X209W, 18-X129Q-X209W, X18K/R-X129Q-X209W, 18-129-213, X18K/R-129-213, 18-X129Q-213, 18-129-X213A, X18K/R-X129Q-213, X18K/R-129-X213A, 18-X129Q-X213A, X18K/R-X129Q-X213A, 18-129-249, X18K/R-129-249, 18-X129Q-249, 18-129-X249N/R, X18K/R-X129Q-249, X18K/R-129-X249N/R, 18-X129Q-X249N/R, X18K/R-X129Q-X249N/R, 18-130-206, X18K/R-130-206, 18-X130A-206, 18-130-X206L/Y, X18K/R-X130A-206, X18K/R-130-X206L/Y, 18-X130A-X206L/Y, X18K/R-X130A-X206L/Y, 18-130-209, X18K/R-130-209, 18-X130A-209, 18-130-X209W, X18K/R-X130A-209, X18K/R-130-X209W, 18-X130A-X209W, X18K/R-X130A-X209W, 18-130-213, X18K/R-130-213, 18-X130A-213, 18-130-X213A, X18K/R-X130A-213, X18K/R-130-X213A, 18-X130A-X213A, X18K/R-X130A-X213A, 18-130-249, X18K/R-130-249, 18-X130A-249, 18-130-X249N/R, X18K/R-X130A-249, X18K/R-130-X249N/R, 18-X130A-X249N/R, X18K/R-X130A-X249N/R, 18-206-209, 18-206-X209W, 18-X206L/Y-209, 18K/R-206-209, 18-X206L/Y-X209W, X18K/R-X206L/Y-209, X18K/R-206-X209W, X18K/R-X206L/Y-X209W, 18-206-213, X18K/R-206-213, 18-206L/Y-213, 18-206-X213A, X18K/R-X206L/Y-213, X18K/R-206-X213A, 18-X206L/Y-X213A, X18K/R-X206L/Y-X213A, 18-206-249, X18K/R-206-249, 18-206L/Y-249, 18-206-X249N/R, X18K/R-X206L/Y-249, X18K/R-206-X249N/R, 18-X206L/Y-X249N/R, X18K/R-X206L/Y-X249N/R, 18-209-213, 18-X209W-213, X18K/R-209-213, 18-209-X213A, 18-X209W-X213A, X18K/R-X209W-213, X18K/R-209-X213A, X18K/R-X209W-X213A, 18-209-249, 18-X209W-249, X18K/R-209-249, 18-209-X249N/R, 18-X209W-X249N/R, X18K/R-X209W-249, X18K/R-209-X249N/R, X18K/R-X209W-X249N/R, 18-213-X249N/R, X18K/R-X213A-249, X18K/R-213-X249N/R, 18-X213A-X249N/R, X18K/R-X213A-X249N/R, 24-78-87, 24-78-X87D/R, 24-X78N-87, X24F/L/P/R-78-87, 24-X78N-X87D/R, X24R/P/F-78-X87D/R, X24F/L/P/R-X78N-87, X24R/P/F-X78N-X87D/R, X24F/L/P-78-129, X24F/L/P-X78N-129, X24F/L/P-78-X129Q, X24F/L/P-X78N-X129Q, X24F/L/P-78-130, X24F/L/P-X78N-130, X24F/L/P-78-X130A, X24F/L/P-X78N-X130A, 24-78-X206Y, X24F/L/P-78-206, 24-X78N-X206Y, X24F/L/P-X78N-206, X24F/L/P-78-X206L/Y, X24F/L/P-X78N-X206L/Y, X24F/L/P-78-209, X24F/L/P-X78N-209, X24F/L/P-78-X209W, X24F/L/P-X78N-X209W, 24-78-213, X24F/L/P/R-78-213, X24F/L/P/R-X78N-213, 24-78-X213A, X24F/L/P/R-X78N-213, X24F/L/P/R-78-X213A, X24F/L/P/R-X78N-X213A, 24-78-X249N/R, 24-X78N-249, 24-X78N-X249N/R, X24F/L/P/R-X78N-249, X24F/L/P/R-78-X249N/R, X24F/L/P/R-X78N-X249N/R, 24-87-129, X24F/L/P/R-87-129, 24-X87D/R-129, 24-87-X129Q, X24F/L/P/R-X87D/R-129, X24F/L/P/R-87-X129Q, 24-X87D/R-X129Q, X24F/L/P/R-X87D/R-X129Q, 24-87-130, X24F/L/P/R-87-130, 24-X87D/R-130, 24-87-X130A, X24F/L/P/R-X87D/R-130, X24F/L/P/R-87-X130A, 24-X87D/R-X130A, X24F/L/P/R-X87D/R-X130A, 24-87-X206L/Y, 24-X87R-206, X24F/L/P/R-87-206, 24-X87D/R-X206L/Y, X24F/L/P/R-X87D/R-206, X24F/L/P/R-87-X206L/Y, X24F/L/P/R-X87D/R-X206L/Y, 24-87-X209W, X24F/L/P/R-87-X209W, 24-87-X209W, 24-87D/R-X209W, X24F/L/P/R-X87D/R-X209W, 24-X87D/R-213, 24-87-X213A, 24-X87D/R-X213A, X24F/L/P/R-X87D/R-213, X24F/L/P/R-87-X213A, X24F/L/P/R-X87D/R-X213A, 24-87-249, X24F/L/P/R-87-249, 24-X87D/R-249, 24-87-X249N/R, X24F/L/P/R-X87D/R-249, X24F/L/P/R-87-X249N/R, 24-X87D/R-X249N/R, X24F/L/P/R-X87D/R-X249N/R, X24F/L/P-129-130, X24F/L/P-X129Q-130, X24F/L/P-129-X130A, X24F/L/P-X129Q-X130A, X24F/L/P-129-206, 24-129-X206Y, X24F/L/P-X129Q-206, X24F/L/P-129-X206Y, 24-X129Q-X206Y, X24F/L/P-X129Q-X206L/Y, X24F/L/P/R-X129Q-X206Y, X24F/L/P-129-209, X24F/L/P-X129Q-209, X24F/L/P-129-X209W, X24F/L/P-X129Q-X209W, 24-129-213, X24F/L/P/R-129-213, 24-X129Q-213, 24-129-X213A, X24F/L/P/R-X129Q-213, X24F/L/P-129-X213A, 24-X129Q-X213A, X24F/L/P/R-X129Q-X213A, 24-129-249, X24F/L/P/R-129-249, 24-X129Q-249, 24-129-X249N/R, X24F/L/P/R-X129Q-249, X24F/L/P/R-129-X249N/R, 24-X129Q-X249N/R, X24F/L/P/R-X129Q-X249N/R, X24F/L/P-130-206, 24-130-X206Y, X24F/L/P-X130A-206, X24F/L/P-130-X206L/Y, X24F/L/P-130-X206Y, 24-X130A-X206Y, X24F/L/P-X130A-X206L/Y, X24F/L/P/R-X130A-X206Y, X24F/L/P-130-209, X24F/L/P-X130A-209, X24F/L/P-130-X209W, X24F/L/P-X130A-X209W, 24-130-213, X24F/L/P-130-213, 24-X130A-213, 24-130-X213A, X24F/L/P/R-X130A-213, X24F/L/P/R-130-X213A, 24-X130A-X213A, X24F/L/P/R-X130A-X213A, 24-130-249, X24F/L/P/R-130-249, 24-X130A-249, 24-130-X249N/R, X24F/L/P/R-X130A-249, X24F/L/P/R-130-X249N/R, 24-X130A-X249N/R, X24F/L/P/R-X130A-X249N/R, 24-X206Y-209, 24F/L/P-206-209, 24-X206Y-X209W, X24F/L/P-X206L/Y-209, X24F/L/P/R-X206Y-209, X24F/L/P-206-X209W, X24F/L/P-X206L/Y-X209W, X24F/L/P/R-X206Y-X209W, 24-206-213, X24F/L/P/R-206-213, 24-X206L/Y-213, 24-206-X213A, X24F/L/P/R-X206L/Y-213, X24F/L/P/R-206-X213A, 24-X206L/Y-X213A, X24F/L/P/R-X206L/Y-X213A, 24-206-249, 24-X206L/Y-249, X24F/L/P/R-206-249, 24-206-X249N/R, X24F/L/P/R-X206L/Y-X249N/R, X24F/L/P/R-X206L/Y-249, X24F/L/P-206-X249N/R, X24F/L/P/R-X206L/Y-X249N/R, 24-209-213, 24-X209W-213, X24F/L/P/R-209-213, 24-209-X213A, X24F/L/P/R-X209W-213, 24-X209W-X213A, X24F/L/P/R-209-X213A, X24F/L/P/R-X209W-X213A, 24-209-249, 24-X209W-249, X24F/L/P/R-209-249, 24-209-X249N/R, X24F/L/P/R-X209W-249, 24-X209W-X249N/R, X24F/L/P/R-209-X249N/R, X24F/L/P/R-X209W-X249N/R, 78-87-129, X78N-87-129, 78-X87D/R-129, 78-87-X129Q, X78N-X87D/R-129, X78N-87-X129Q, 78-X87D/R-X129Q, X78N-X87D/R-X129Q, 78-87-130, X78N-87-130, 78-X87D/R-130, 78-87-X130A, X78N-X87D/R-130, X78N-87-X130A, 78-X87D/R-X130A, X78N-X87D/R-X130A, 78-87-206, 78-87-X206L/R/Y, X78N-87-206, 78-X87D/R-206, 78-X87D/R-X206L/R/Y, X78N-87-X206L/R/Y, X78N-X87D/R-206, X78N-X87D/R-X206L/R/Y, 78-87-209, 78-87-X209W, X78N-87-209, 78-X87D/R-209, X78N-X87D/R-209, 78-X87D/R-X209W, X78N-87-X209W, X78N-X87D/R-X209W, 78-87-213, X78N-87-213, 78-X87D/R-213, 78-87-X213A, X78N-X87D/R-213, X78N-87-X213A, 78-X87D/R-X213A, X78N-X87D/R-X213A, 78-87-249, 78-87-X249N/R, X78N-87-249, 78-X87D/R-249, X78N-X87D/R-249, 78-X87D/R-X249N/R, X78N-87-X249N/R, X78N-X87D/R-X249N/R, 78-129-X206R/Y, X78N-129-X206Y, 78-X129Q-X206R/Y, X78N-X129Q-X206Y, 78-129-213, X78N-129-213, 78-X129Q-213, 78-129-X213A, X78N-X129Q-213, X78N-129-X213A, 78-X129Q-X213A, X78N-X129Q-X213A, 78-129-249, X78N-129-249, 78-X129Q-249, 78-129-X249N/R, X78N-X129Q-249, X78N-129-X249N/R, 78-X129Q-X249N/R, X78N-X129Q-X249N/R, 78-130-X206R/Y, X78N-130-X206Y, 78-X130A-X206R/Y, X78N-X130A-X206Y, 78-130-213, X78N-130-213, 78-X130A-213, 78-130-X213A, X78N-X130A-213, X78N-130-X213A, 78-X130A-X213A, X78N-X130A-X213A, 78-130-213, X78N-130-213, 78-X130A-213, 78-130-X213A, X78N-X130A-213, X78N-130-X213A, 78-X130A-X213A, X78N-X130A-X213A, 78-130-249, X78N-130-249, 78-X130A-249, 78-130-X249N/R, X78N-X130A-249, X78N-130-X249N/R, 78-X130A-X249N/R, X78N-X130A-X249N/R, 78-206-209, X78N-206-209, 78-X206L/Y-209, 78-206-X209W, X78N-X206L/Y-209, X78N-206-X209W, 78-X206L/Y-X209W, X78N-X206L/Y-X209W, 78-206-213, X78N-206-213, 78-X206L/Y-213, 78-206-X213A, X78N-X206L/Y-213, X78N-206-X213A, 78-X206L/Y-X213A, X78N-X206L/Y-X213A, 78-206-249, 78-206-X249R/N, 78-X206L/Y-249, X78N-206-249, X78N-206-X249N/R, 78-X206L/Y-X249N/R, X78N-X206L/Y-249, X78N-X206L/Y-X249N/R, 78-209-213, 78-X209W-213, 78-209-X213A, X78N-209-213, X78N-X209W-213, X78N-209-X213A, 78-X209W-X213A, X78N-X209W-X213A, 78-209-249, 78-X209W-249, 78-209-X249N/R, X78N-209-249, 78-X209W-X249N/R, X78N-X209W-249, X78N-209-X249N/R, X78N-X209W-X249N/R, 78-213-249, 78-X213A-249, X78N-213-249, 78-213-X249N/R, X78N-X213A-249, X78N-213-X249N/R, 78-X213A-X249N/R, X78N-X213A-X249N/R, 87-129-130, X87D/R-129-130, 87-X129Q-130, 87-129-X130A, X87D/R-X129Q-130, X87D/R-129-X130A, 87-X129Q-X130A, X87D/R-X129Q-X130A, 87-129-206, X87D/R-129-206, 87-X129Q-206, 87-129-X206L/R/Y, X87D/R-X129Q-206, X87D/R-129-X206L/R/Y, 87-X129Q-X206L/R/Y, X87D/R-X129Q-X206L/R/Y, 87-129-209, X87D/R-129-209, 87-X129Q-209, 87-129-X209W, X87D/R-X129Q-209, X87D/R-129-X209W, 87-X129Q-X209W, X87D/R-X129Q-X209W, 87-129-213, X87D/R-129-213, 87-X129Q-213, 87-129-X213A, X87D/R-X129Q-213, X87D/R-129-X213A, 87-X129Q-X213A, X87D/R-X129Q-X213A, 87-129-249, X87D/R-129-249, 87-X129Q-249, 87-129-X249N/R, X87D/R-X129Q-249, X87D/R-129-X249N/R, 87-X129Q-X249N/R, X87D/R-X129Q-X249N/R, 87-130-206, X87D/R-130-206, 87-X130A-206, 87-130-X206L/R/Y, X87D/R-X130A-206, X87D/R-130-X206L/R/Y, 87-X130A-X206L/R/Y, X87D/R-X130A-X206L/R/Y, 87-130-209, X87D/R-130-209, 87-X130A-209, 87-130-X209W, X87D/R-X130A-209, X87D/R-130-X209W, 87-X130A-X209W, X87D/R-X130A-X209W, 87-130-213, X87D/R-130-213, 87-X130A-213, 87-130-X213A, X87D/R-X130A-213, X87D/R-130-X213A, 87-X130A-X213A, X87D/R-X130A-X213A, 87-130-249, X87D/R-130-249, 87-X130A-249, 87-130-X249N/R, X87D/R-X130A-249, X87D/R-130-X249N/R, 87-X130A-X249N/R, X87D/R-X130A-X249N/R, 87-206-209, X87D/R-206-209, 87-X206L/Y-209, 87-206-X209W, X87D/R-X206L/Y-209, X87D/R-206-X209W, X87D/R-X206L/Y-X209W, 87-206-213, 87-X206L/Y-213, 87-206-X213A, X87D/R-206-213, X87D/R-X206L/Y-213, X87D/R-206-X213A, 87-X206L/Y-X213A, X87D/R-X206L/Y-X213A, 87-206-249, X87D/R-206-249, 87-209-X249N/R, X87R-206-X249N/R, X87D/R-X206L/Y-249, 87-X206L/Y-X249N/R, X87R-X206L/Y-X249N/R, 87-209-213, X87D/R-209-213, 87-X209W-213, 87-209-X213A, X87D/R-X209W-213, X87D/R-209-X213A, 87-X209W-X213A, X87D/R-X209W-X213A, 87-209-249, 87-X209W-249, 87-209-X249N/R, X87D/R-209-249, X87D/R-X209W-249, 87-X209W-X249N/R, X87D/R-209-X249N/R, X87D/R-X209W-X249N/R, 87-213-249, 87-X213A-249, X87D/R-213-249, 87-213-X249N/R, X87D/R-X213A-249, X87D/R-213-X249N/R, 87-X213A-X249N/R, X87D/R-X213A-X249N/R, 129-130-X206R/Y, X129Q-130-X206R/Y, 129-X130A-X206R/Y, X129Q-X130A-X206R/Y, 129-130-213, X129Q-130-213, 129-X130A-213, 129-130-X213A, X129Q-X130A-213, X129Q-130-X213A, 129-X130A-X213A, X129Q-X130A-X213A, 129-130-249, X129Q-130-249, 129-X130A-249, 129-130-X249N/R, X129Q-X130A-249, X129Q-130-X249N/R, 129-X130A-X249N/R, X129Q-X130A-X249N/R, 129-X206Y-209, X129Q-X206Y-209, 129-X206Y-X209W, X129Q-X206Y-X209W, 129-206-213, 129-X206L/Y-213, 129-206-X213A, X129Q-206-213, X129Q-X206L/Y-213, X129Q-206-X213A, 129-X206L/Y-X213A, X129Q-X206L/Y-X213A, 129-206-249, 129-X206L/Y-249, 129-206-X249N/R, X129Q-206-249, X129A-X206L/Y-249, X129Q-206-X249N/R, 129-X206L/Y-X249N/R, X129Q-X206L/Y-X249N/R, 129-209-213, 129-X209W-213, 129-209-X213A, X129Q-209-213, X129Q-X209W-213, X129Q-209-X213A, 129-X209W-X213A, X129Q-X209W-X213A, 129-209-249, 129-X209W-249, 129-209-X249N/R, X129Q-209-249, X129Q-X209W-249, X129Q-209-X249N/R, 129-X209W-X249N/R, X129Q-X209W-X249N/R, 129-213-249, 129-X213A-249, 129-213-X249N/R, X129Q-213-249, X129Q-X213A-249, 129-X213A-X249R, X129Q-213-X249N/R, X129Q-X213A-X249N/R, 130-X206Y-209, X130A-X206Y-209, 130-X206Y-X209W, X130A-X206Y-X209W, 130-206-213, 130-X206L/Y-213, 130-206-X213A, X130A-206-213, X130A-X206L/Y-213, X130A-206-X213A, 130-X206L/Y-X213A, X130A-X206L/Y-X213A, 130-206-249, 130-X206L/Y-249, 130-206-X249N/R, X130A-206-249, X130A-X206L/Y-249, X130A-206-X249N/R, 130-X206L/Y-X249N/R, X130A-X206L/Y-X249N/R, 130-209-213, 130-X209W-213, 130-209-X213A, X130A-209-213, X130A-X209W-213, X130A-209-X213A, 130-X209W-X213A, X130A-X209W-X213A, 130-209-249, 130-X209W-249, 130-209-X249N/R, X130A-209-249, X130A-X209W-249, X130A-209-X249N/R, 130-X209W-X249N/R, X130A-X209W-X249N/R, 130-213-249, 130-X213A-249, 130-213-X249N/R, X130A-213-249, X130A-X213A-249, 130-X213A-X249R, X130A-213-X249N/R, X130A-X213A-X249N/R, 130-209-249, 130-X209W-249, 130-209-X249N/R, X130A-209-249, X130A-X209W-249, X130A-209-X249N/R, 130-X209W-X249N/R, X130A-X209W-X249N/R, 206-209-213, 206-X209W-213, 206-209-X213A, X206L/Y-209-213, 206-X209W-X213A, X206L/Y-X209W-213, X206L/Y-209-X213A, X206L/Y-X209W-X213A, 206-209-249, 206-X209W-249, 206-209-X249N/R, X206L/Y-209-249, X206L/Y-X209W-249, 206-X209W-X249N/R, X206L/Y-209-X249N/R, X206L/Y-X209W-X249N/R, 206-213-249, 206-X213A-249, 206-213-X249N/R X206L/Y-213-249, X206L/Y-X213A-249, X206L/Y-213-X249N/R, 206-X213A-X249N/R, X206L/Y-X213A-X249N/R, 209-213-249, X209W-213-249, 209-X213A-249, 209-213-X249N/R, X209W-X213A-249, X209W-213-X249N/R, 209-X213A-X249N/R, X209W-X213A-X249N/R, and combinations thereof, wherein X is any amino acid, said variant has proteolytic activity and the amino acid sequence of said variant further comprises one or more substitutions selected from: (i) 3, 76, 101, 103, 104, 118, 127, 128, 166, 210, 217, 222, and 261; (ii) X3V X76D, X101F/G/V, X103A/D/P, X104I, X118R, X127T, X128L/R, X166D/N, X210I, X217K, X222Q/S, and X261I; or (iii) S3V, N76D, S101F/G/V, S103A/D/P, V104I, G118R, G127T, S128L/R, S166D/N, P210I, L217K, M222Q/S, and N261I; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence.

Yet another embodiment provides an isolated subtilisin variant comprising an amino acid sequence comprising a combination of amino acid substitutions at two or more positions selected from: 78-X206L/Y, X78N-206, X78N-X206L/Y, 18-X78N, X18K/R-X78N, 18-X87R, X18K/R-X87R, 18-X206L/Y, X18K/R-X206L/Y, 24-X87R, X24F/P/R-X87R, 24-X206L/Y, X24F/P/R-206, X24F/P/R-X206L/Y, 24-X209W, X24F/P/R-X209W, X78N-87, X78N-X87D/R, 78-X129Q, X78N-X129Q, 78-X130A, X78N-130, X78N-209, 78-X209W, X78N-X209W, 78-X249N/R, X78N-249, X78N-X249N/R, 87-X206L/Y, X87D/R-X206L/Y, 87-X209W, X87D/R-X209W, 87-X213A, X87D/R-213, X87D/R-X213A, X87R-X249N/R, 129-X206L/Y, X129Q-206, X129Q-X206L/Y, 129-X209W, X129Q-X209W, 129-X249N/R, X129Q-249, X129Q-X249N/R, 130-X206L/Y, X130A-206, X130A-X206L/Y, 130-X209W, X130A-X209W, 130-X249N/R, X130A-249, X130A-X249N/R, 206-X209W, X206L/Y-209, X206L/Y-X209W, 206-X213A, X206L/Y-213, X206L/Y-X213A, X206L/Y-249, X206L/Y-X249N/R, X209W-213, X209W-X213A, X209W-249, X209W-X249N/R, 18-24-78, X18K/R-24-78, 18-X24F/P/R-78, 18-24-X78N, X18K/R-24-X78N, 18-X24F/P/R-X78N, X18K/R-X24F/P/R-78, X18K/R-X24F/P/R-X78N, 18-24-87, X18K/R-24-87, 18-X24F/P/R-87, 18-24-X87D/R, X18K/R-24-X87D/R, 18-X24F/P/R-X87D/R, X18K/R-X24F/P/R-87, X18K/R-X24F/P/R-X87D/R, 18-24-129, X18K/R-24-129, 18-X24F/P/R-129, 18-24-X129Q, X18K/R-X24F/P/R-129, X18K/R-24-X129Q, 18-X24F/P/R-X129Q, X18K/R-X24F/P/R-X129Q, 18-24-130, 18-X24F/P/R-130, 18-24-X130A, X18K/R-24-130, X18K/R-X24F/P/R-130, X18K/R-24-X130A, 18-X24F/P/R-X130A, X18K/R-X24F/P/R-X130A, 18-24-206, 18-24-X206L/Y, 18-X24F/P/R-206, X18K/R-24-206, X18K/R-24-X206L/Y, 18-X24F/P/R-X206L/Y, X18K/R-X24F/P/R-206, X18K/R-X24F/P/R-X206L/Y, 18-24-209, 18-24-X209W, 18-X24F/P/R-209, X18K/R-24-209, X18K/R-24-X209W, 18-X24F/P/R-X209W, X18K/R-X24F/P/R-209, X18K/R-X24F/P/R-X209W, 18-78-87, 18-X78N-87, 18-78-X87D/R, X18K/R-78-87, X18K/R-X78N-87, X18K/R-78-X87D/R, 18-X78N-X87D/R, X18K/R-X78N-X87D/R, 18-78-129, 18-X78N-129, 18-78-X129Q, X18K/R-78-129, X18K/R-X78N-129, X18K/R-78-X129Q, 18-X78N-X129Q, X18K/R-X78N-X129Q, 18-78-130, 18-X78N-130, 18-78-X130A, X18K/R-78-130, X18K/R-X78N-130, X18K/R-78-X130A, 18-X78N-X130A, X18K/R-X78N-X130A, 18-78-206, 18-78-X206L/Y, 18-X78N-206, X18K/R-78-206, 18-X78N-X206L/Y, X18K/R-X78N-206, X18K/R-78-X206L/Y, X18K/R-X78N-X206L/Y, 18-78-209, 18-X78N-209, 18-78-X209W, X18K/R-78-209, X18K/R-78-X209W, 18-X78N-X209W, X18K/R-X78N-209, X18K/R-X78N-X209W, 18-78-213, 18-X78N-213, 18-78-X213A, X18K/R-78-213, 18-X78N-X213A, X18K/R-X78N-213, X18K/R-78-X213A, X18K/R-X78N-X213A, 18-78-249, 18-78-X249N/R, 18-X78N-249, X18K/R-78-249, 18-X78N-X249N/R, X18K/R-X78N-249, X18K/R-78-X249N/R, X18K/R-X78N-X249N/R, 18-87-129, X18K/R-87-129, 18-X87D/R-129, 18-87-X129Q, 18-X87D/R-X129Q, X18K/R-87-X129Q, X18K/R-X87D/R-129, X18K/R-X87D/R-X129Q, 18-87-130, X18K/R-87-130, 18-X87D/R-130, 18-87-X130A, 18-X87D/R-X130A, X18K/R-87-X130A, X18K/R-X87D/R-130, X18K/R-X87D/R-X130A, 18-87-206, X18K/R-87-206, 18-X87D/R-206, 18-87-X206L/Y, 18-X87D/R-X206L/Y, X18K/R-87-X206L/Y, X18K/R-X87D/R-206, X18K/R-X87D/R-X206L/Y, 18-87-209, X18K/R-87-209, 18-X87D/R-209, 18-87-X209W, 18-X87D/R-X209W, X18K/R-X87D/R-209, X18K/R-87-X209W, X18K/R-X87D/R-X209W, 18-X87D/R-213, 18-87-X213A, 18-X87D/R-X213A, X18K/R-X87D/R-213, X18K/R-87-X213A, X18K/R-X87D/R-X213A, 18-87-249, X18K/R-87-249, 18-X87D/R-249, 18-87-X249N/R, 18-X87D/R-249N/R, 18K/R-X87D/R-249, 18K/R-87-X249N/R, 18K/R-X87D/R-X249N/R, 18-129-130, X18K/R-129-130, 18-X129Q-130, 18-129-X130A, X18K/R-X129Q-130, X18K/R-129-X130A, 18-X129Q-X130A, X18K/R-X129Q-X130A, 18-129-206, X18K/R-129-206, 18-X129Q-206, 18-129-X206L/Y, X18K/R-X129Q-206, X18K/R-129-X206L/Y, 18-X129Q-X206L/Y, X18K/R-X129Q-X206L/Y, 18-129-209, X18K/R-129-209, 18-X129Q-209, 18-129-X209W, X18K/R-X129Q-209, X18K/R-129-X209W, 18-X129Q-X209W, X18K/R-X129Q-X209W, 18-129-213, X18K/R-129-213, 18-X129Q-213, 18-129-X213A, X18K/R-X129Q-213, X18K/R-129-X213A, 18-X129Q-X213A, X18K/R-X129Q-X213A, 18-129-249, X18K/R-129-249, 18-X129Q-249, 18-129-X249N/R, X18K/R-X129Q-249, X18K/R-129-X249N/R, 18-X129Q-X249N/R, X18K/R-X129Q-X249N/R, 18-130-206, X18K/R-130-206, 18-X130A-206, 18-130-X206L/Y, X18K/R-X130A-206, X18K/R-130-X206L/Y, 18-X130A-X206L/Y, X18K/R-X130A-X206L/Y, 18-130-209, X18K/R-130-209, 18-X130A-209, 18-130-X209W, X18K/R-X130A-209, X18K/R-130-X209W, 18-X130A-X209W, X18K/R-X130A-X209W, 18-130-213, X18K/R-130-213, 18-X130A-213, 18-130-X213A, X18K/R-X130A-213, X18K/R-130-X213A, 18-X130A-X213A, X18K/R-X130A-X213A, 18-130-249, X18K/R-130-249, 18-X130A-249, 18-130-X249N/R, X18K/R-X130A-249, X18K/R-130-X249N/R, 18-X130A-X249N/R, X18K/R-X130A-X249N/R, 18-206-209, 18-206-X209W, 18-X206L/Y-209, 18K/R-206-209, 18-X206L/Y-X209W, X18K/R-X206L/Y-209, X18K/R-206-X209W, X18K/R-X206L/Y-X209W, 18-206-213, X18K/R-206-213, 18-206L/Y-213, 18-206-X213A, X18K/R-X206L/Y-213, X18K/R-206-X213A, 18-X206L/Y-X213A, X18K/R-X206L/Y-X213A, 18-206-249, X18K/R-206-249, 18-206L/Y-249, 18-206-X249N/R, X18K/R-X206L/Y-249, X18K/R-206-X249N/R, 18-X206L/Y-X249N/R, X18K/R-X206L/Y-X249N/R, 18-209-213, 18-X209W-213, X18K/R-209-213, 18-209-X213A, 18-X209W-X213A, X18K/R-X209W-213, X18K/R-209-X213A, X18K/R-X209W-X213A, 18-209-249, 18-X209W-249, X18K/R-209-249, 18-209-X249N/R, 18-X209W-X249N/R, 18K/R-X209W-249, X18K/R-209-X249N/R, X18K/R-X209W-X249N/R, 18-213-X249N/R, X18K/R-X213A-249, X18K/R-213-X249N/R, 18-X213A-X249N/R, X18K/R-X213A-X249N/R, 24-78-87, 24-78-X87D/R, 24-X78N-87, X24F/P/R-78-87, 24-X78N-X87D/R, X24R/P/F-78-X87D/R, X24F/P/R-X78N-87, X24R/P/F-X78N-X87D/R, 24-78-129, X24F/P/R-78-129, 24-X78N-129, 24-78-X129Q, X24F/P/R-X78N-129, X24F/P/R-78-X129Q, 24-X78N-X129Q, X24F/P/R-X78N-X129Q, 24-78-130, X24F/P/R-78-130, 24-X78N-130, 24-78-X130A, X24F/P/R-X78N-130 X24F/P/R-78-X130A, 24-X78N-X130A, X24F/P/R-X78N-X130A, 24-78-X206L/Y, X24F/P/R-78-206, 24-X78N-X206L/Y, X24F/P/R-X78N-206, X24F/P/R-78-X206L/Y, X24F/P/R-X78N-X206L/Y, 24-78-209, X24F/P/R-78-209, 24-X78N-209, 24-78-X209W, X24F/P/R-X78N-209, X24F/P/R-78-X209W, 24-X78N-X209W, X24F/P/R-X78N-X209W, 24-78-213, X24F/P/R-78-213, 24-X78N-213, 24-78-X213A, X24F/P/R-X78N-213, X24F/P/R-78-X213A, 24-X78N-X213A, X24F/P/R-X78N-X213A, 24-78-X249N/R, 24-X78N-249, 24-X78N-X249N/R, X24F/P/R-X78N-249, X24F/P/R-78-X249N/R, X24F/P/R-X78N-X249N/R, 24-87-129, X24F/P/R-87-129, 24-X87D/R-129, 24-87-X129Q, X24F/P/R-X87D/R-129, X24F/P/R-87-X129Q, 24-X87D/R-X129Q, X24F/P/R-X87D/R-X129Q, 24-87-130, X24F/P/R-87-130, 24-X87D/R-130, 24-87-X130A, X24F/P/R-X87D/R-130, X24F/P/R-87-X130A, 24-X87D/R-X130A, X24F/P/R-X87D/R-X130A, 24-87-X206L/Y, 24-X87R-206, X24F/P/R-87-206, 24-X87D/R-X206L/Y, X24F/P/R-X87D/R-206, X24F/P/R-87-X206L/Y, X24F/P/R-X87D/R-X206L/Y, 24-87-X209W, X24F/P/R-87-X209W, 24-87-X209W, 24-87D/R-X209W, X24F/P/R-X87D/R-X209W, 24-X87D/R-213, 24-87-X213A, 24-X87D/R-X213A, X24F/P/R-X87D/R-213, X24F/P/R-87-X213A, X24F/P/R-X87D/R-X213A, 24-87-249, X24F/P/R-87-249, 24-X87D/R-249, 24-87-X249N/R, X24F/P/R-X87D/R-249, X24F/P/R-87-X249N/R, 24-X87D/R-X249N/R, X24F/P/R-X87D/R-X249N/R, 24-129-130, X24F/P/R-129-130, 24-X129Q-130, 24-129-X130A, X24F/P/R-X129Q-130, X24F/P/R-129-X130A, 24-X129Q-X130A, X24F/P/R-X129Q-X130A, 24-129-206, X24F/P/R-129-206, 24-X129Q-206, 24-129-X206L/Y, X24F/P/R-X129Q-206, X24F/P/R-129-X206L/Y, 24-X129Q-X206L/Y, X24F/P/R-X129Q-X206L/Y, 24-129-209, X24F/P/R-129-209, 24-X129Q-209, 24-129-X209W, X24F/P/R-X129Q-209, X24F/P/R-129-X209W, 24-X129Q-X209W, X24F/P/R-X129Q-X209W, 24-129-213, X24F/P/R-129-213, 24-X129Q-213, 24-129-X213A, X24F/P/R-X129Q-213, X24F/P/R-129-X213A, 24-X129Q-X213A, X24F/P/R-X129Q-X213A, 24-129-249, X24F/P/R-129-249, 24-X129Q-249, 24-129-X249N/R, X24F/P/R-X129Q-249, X24F/P/R-129-X249N/R, 24-X129Q-X249N/R, X24F/P/R-X129Q-X249N/R, 24-130-206, X24F/P/R-130-206, 24-X130A-206, 24-130-X206L/Y, X24F/P/R-X130A-206, X24F/P/R-130-X206L/Y, 24-X130A-X206L/Y, X24F/P/R-X130A-X206L/Y, 24-130-209, X24F/P/R-130-209, 24-X130A-209, 24-130-X209W, X24F/P/R-X130A-209, X24F/P/R-130-X209W, 24-X130A-X209W, X24F/P/R-X130A-X209W, 24-130-213, X24F/P/R-130-213, 24-X130A-213, 24-130-X213A, X24F/P/R-X130A-213, X24F/P/R-130-X213A, 24-X130A-X213A, X24F/P/R-X130A-X213A, 24-130-249, X24F/P/R-130-249, 24-X130A-249, 24-130-X249N/R, X24F/P/R-X130A-249, X24F/P/R-130-X249N/R, 24-X130A-X249N/R, X24F/P/R-X130A-X249N/R, 24-206-209, 24-206-X209W, 24-X206L/Y-209, 24F/P/R-206-209, X24F/P/R-X206L/Y-X209W, X24F/P/R-X206L/Y-209, X24F/P/R-206-X209W, X24F/P/R-X206L/Y-X209W, 24-206-213, X24F/P/R-206-213, 24-X206L/Y-213, 24-206-X213A, X24F/P/R-X206L/Y-213, X24F/P/R-206-X213A, 24-X206L/Y-X213A, X24F/P/R-X206L/Y-X213A, 24-206-249, 24-X206L/Y-249, X24F/P/R-206-249, 24-206-X249N/R, 24-X206L/Y-X249N/R, X24F/P/R-X206L/Y-249, X24F/P/R-206-X249N/R, X24F/P/R-X206L/Y-X249N/R, 24-209-213, 24-X209W-213, X24F/P/R-209-213, 24-209-X213A, X24F/P/R-X209W-213, 24-X209W-X213A, X24F/P/R-209-X213A, X24F/P/R-X209W-X213A, 24-209-249, 24-X209W-249, X24F/P/R-209-249, 24-209-X249N/R, X24F/P/R-X209W-249, 24-X209W-X249N/R, X24F/P/R-209-X249N/R, X24F/P/R-X209W-X249N/R, 78-87-129, X78N-87-129, 78-X87D/R-129, 78-87-X129Q, X78N-X87D/R-129, X78N-87-X129Q, 78-X87D/R-X129Q, X78N-X87D/R-X129Q, 78-87-130, X78N-87-130, 78-X87D/R-130, 78-87-X130A, X78N-X87D/R-130, X78N-87-X130A, 78-X87D/R-X130A, X78N-X87D/R-X130A, 78-87-206, 78-87-X206L/Y, X78N-87-206, 78-X87D/R-206, 78-X87D/R-X206L/Y, X78N-87-X206L/Y, X78N-X87D/R-206, X78N-X87D/R-X206L/Y, 78-87-209, 78-87-X209W, X78N-87-209, 78-X87D/R-209, X78N-X87D/R-209, 78-X87D/R-X209W, X78N-87-X209W, X78N-X87D/R-X209W, 78-87-213, X78N-87-213, 78-X87D/R-213, 78-87-X213A, X78N-X87D/R-213, X78N-87-X213A, 78-X87D/R-X213A, X78N-X87D/R-X213A, 78-87-249, 78-87-X249N/R, X78N-87-249, 78-87D/R-249, X78N-X87D/R-249, 78-X87D/R-X249N/R, X78N-87-X249N/R, X78N-X87D/R-X249N/R, 78-129-130, X78N-129-130, 78-X129Q-130, 78-129-X130A, X78N-X129Q-130, X78N-129-X130A, 78-X129Q-X130A, X78N-X129Q-X130A, 78-129-206, X78N-129-206, 78-X129Q-206, 78-129-X206L/Y, X78N-X129Q-206, X78N-129-X206L/Y, 78-X129Q-X206L/Y, X78N-X129Q-X206L/Y, 78-129-209, X78N-129-209, 78-X129Q-209, 78-129-X209W, X78N-X129Q-209, X78N-129-X209W, 78-X129Q-X209W, X78N-X129Q-X209W, 78-129-213, X78N-129-213, 78-X129Q-213, 78-129-X213A, X78N-X129Q-213, X78N-129-X213A, 78-X129Q-X213A, X78N-X129Q-X213A, 78-129-249, X78N-129-249, 78-X129Q-249, 78-129-X249N/R, X78N-X129Q-249, X78N-129-X249N/R, 78-X129Q-X249N/R, X78N-X129Q-X249N/R, 78-130-206, X78N-130-206, 78-X130A-206, 78-130-X206L/Y, X78N-X130A-206, X78N-130-X206L/Y, 78-X130A-X206L/Y, X78N-X130A-X206L/Y, 78-130-209, X78N-130-209, 78-X130A-209, 78-130-X209W, X78N-X130A-209, X78N-130-X209W, 78-X130A-X209W, X78N-X130A-X209W, 78-130-213, X78N-130-213, 78-X130A-213, 78-130-X213A, X78N-X130A-213, X78N-130-X213A, 78-X130A-X213A, X78N-X130A-X213A, 78-130-213, X78N-130-213, 78-X130A-213, 78-130-X213A, X78N-X130A-213, X78N-130-X213A, 78-X130A-X213A, X78N-X130A-X213A, 78-130-249, X78N-130-249, 78-X130A-249, 78-130-X249N/R, X78N-X130A-249, X78N-130-X249N/R, 78-X130A-X249N/R, X78N-X130A-X249N/R, 78-206-209, X78N-206-209, 78-X206L/Y-209, 78-206-X209W, X78N-X206L/Y-209, X78N-206-X209W, 78-X206L/Y-X209W, X78N-X206L/Y-X209W, 78-206-213, X78N-206-213, 78-X206L/Y-213, 78-206-X213A, X78N-X206L/Y-213, X78N-206-X213A, 78-X206L/Y-X213A, X78N-X206L/Y-X213A, 78-206-249, 78-206-X249R/N, 78-X206L/Y-249, X78N-206-249, X78N-206-X249N/R, 78-X206L/Y-X249N/R, X78N-X206L/Y-249, X78N-X206L/Y-X249N/R, 78-209-213, 78-X209W-213, 78-209-X213A, X78N-209-213, X78N-X209W-213, X78N-209-X213A, 78-X209W-X213A, X78N-X209W-X213A, 78-209-249, 78-X209W-249, 78-209-X249N/R, X78N-209-249, 78-X209W-X249N/R, X78N-X209W-249, X78N-209-X249N/R, X78N-X209W-X249N/R, 78-213-249, 78-X213A-249, X78N-213-249, 78-213-X249N/R, X78N-X213A-249, X78N-213-X249N/R, 78-X213A-X249N/R, X78N-X213A-X249N/R, 87-129-130, X87D/R-129-130, 87-X129Q-130, 87-129-X130A, X87D/R-X129Q-130, X87D/R-129-X130A, 87-X129Q-X130A, X87D/R-X129Q-X130A, 87-129-206, X87D/R-129-206, 87-X129Q-206, 87-129-X206L/Y, X87D/R-X129Q-206, X87D/R-129-X206L/Y, 87-X129Q-X206L/Y, X87D/R-X129Q-X206L/Y, 87-129-209, X87D/R-129-209, 87-X129Q-209, 87-129-X209W, X87D/R-X129Q-209, X87D/R-129-X209W, 87-X129Q-X209W, X87D/R-X129Q-X209W, 87-129-213, X87D/R-129-213, 87-X129Q-213, 87-129-X213A, X87D/R-X129Q-213, X87D/R-129-X213A, 87-X129Q-X213A, X87D/R-X129Q-X213A, 87-129-249, X87D/R-129-249, 87-X129Q-249, 87-129-X249N/R, X87D/R-X129Q-249, X87D/R-129-X249N/R, 87-X129Q-X249N/R, X87D/R-X129Q-X249N/R, 87-130-206, X87D/R-130-206, 87-X130A-206, 87-130-X206L/Y, X87D/R-X130A-206, X87D/R-130-X206L/Y, 87-X130A-X206L/Y, X87D/R-X130A-X206L/Y, 87-130-209, X87D/R-130-209, 87-X130A-209, 87-130-X209W, X87D/R-X130A-209, X87D/R-130-X209W, 87-X130A-X209W, X87D/R-X130A-X209W, 87-130-213, X87D/R-130-213, 87-X130A-213, 87-130-X213A, X87D/R-X130A-213, X87D/R-130-X213A, 87-X130A-X213A, X87D/R-X130A-X213A, 87-130-249, X87D/R-130-249, 87-X130A-249, 87-130-X249N/R, X87D/R-X130A-249, X87D/R-130-X249N/R, 87-X130A-X249N/R, X87D/R-X130A-X249N/R, 87-206-209, X87D/R-206-209, 87-X206L/Y-209, 87-206-X209W, X87D/R-X206L/Y-209, X87D/R-206-X209W, 87-X206L/Y-X209W, X87D/R-X206L/Y-X209W, 87-206-213, 87-X206L/Y-213, 87-206-X213A, X87D/R-206-213, X87D/R-X206L/Y-213, X87D/R-206-X213A, 87-X206L/Y-X213A, X87D/R-X206L/Y-X213A, 87-206-249, 87-X206L/Y-249, 87D/R-206-249, 87-209-X249N/R, X87R-206-X249N/R, X87D/R-X206L/Y-249, 87-X206L/Y-X249N/R, X87R-X206L/Y-X249N/R, 87-209-213, X87D/R-209-213, 87-X209W-213, 87-209-X213A, X87D/R-X209W-213, X87D/R-209-X213A, 87-X209W-X213A, X87D/R-X209W-X213A, 87-209-249, 87-X209W-249, 87-209-X249N/R, X87D/R-209-249, X87D/R-X209W-249, 87-X209W-X249N/R, X87R-209-X249N/R, X87D/R-X209W-X249N/R, 87-213-249, 87-X213A-249, X87D/R-213-249, 87-213-X249N/R, X87D/R-X213A-249, X87D/R-213-X249N/R, 87-X213A-X249N/R, X87D/R-X213A-X249N/R, 129-130-206, X129Q-130-206, 129-X130A-206, 129-130-X206L/Y, X129Q-X130A-206, X129Q-130-X206L/Y, 129-X130A-X206L/Y, X129Q-X130A-X206L/Y, 129-130-209, X129Q-130-209, 129-X130A-209, 129-130-X209W, X129Q-X130A-209, X129Q-130-X209W, 129-X130A-X209W, X129Q-X130A-X209W, 129-130-213, X129Q-130-213, 129-X130A-213, 129-130-X213A, X129Q-X130A-213, X129Q-130-X213A, 129-X130A-X213A, X129Q-X130A-X213A, 129-130-249, X129Q-130-249, 129-X130A-249, 129-130-X249N/R, X129Q-X130A-249, X129Q-130-X249N/R, 129-X130A-X249N/R, X129Q-X130A-X249N/R, 129-206-209, X129Q-206-209, 129-X206L/Y-209, 129-206-X209W, X129Q-X206L/Y-209, X129Q-206-X209W, 129-X206L/Y-X209W, X129Q-X206L/Y-X209W, 129-206-213, 129-X206L/Y-213, 129-206-X213A, X129Q-206-213, X129Q-X206L/Y-213, X129Q-206-X213A, 129-X206L/Y-X213A, X129Q-X206L/Y-X213A, 129-206-249, 129-X206L/Y-249, 129-206-X249N/R, X129Q-206-249, X129A-X206L/Y-249, X129Q-206-X249N/R, 129-X206L/Y-X249N/R, X129Q-X206L/Y-X249N/R, 129-209-213, 129-X209W-213, 129-209-X213A, X129Q-209-213, X129Q-X209W-213, X129Q-209-X213A, 129-X209W-X213A, X129Q-X209W-X213A, 129-209-249, 129-X209W-249, 129-209-X249N/R, X129Q-209-249, X129Q-X209W-249, X129Q-209-X249N/R, 129-X209W-X249N/R, X129Q-X209W-X249N/R, 129-213-249, 129-X213A-249, 129-213-X249N/R, X129Q-213-249, X129Q-X213A-249, 129-X213A-X249R, X129Q-213-X249N/R, X129Q-X213A-X249N/R, 130-206-209, X130A-206-209, 130-X206L/Y-209, 130-209-X209W, X130A-X206L/Y-209, 130-206-X209W, 130-X206L/Y-X209W, X130A-X206L/Y-X209W, 130-206-213, 130-X206L/Y-213, 130-206-X213A, X130A-206-213, X130A-X206L/Y-213, X130A-206-X213A, 130-X206L/Y-X213A, X130A-X206L/Y-X213A, 130-206-249, 130-X206L/Y-249, 130-206-X249N/R, X130A-206-249, X130A-X206L/Y-249, X130A-206-X249N/R, 130-X206L/Y-X249N/R, X130A-X206L/Y-X249N/R, 130-209-213, 130-X209W-213, 130-209-X213A, X130A-209-213, X130A-X209W-213, X130A-209-X213A, 130-X209W-X213A, X130A-X209W-X213A, 130-209-249, 130-X209W-249, 130-209-X249N/R, X130A-209-249, X130A-X209W-249, 130-209-X249N/R, 130-X209W-X249N/R, X130A-X209W-X249N/R, 130-213-249, 130-X213A-249, 130-213-X249N/R, X130A-213-249, X130A-X213A-249, 130-X213A-X249R, X130A-213-X249N/R, X130A-X213A-X249N/R, 130-209-249, 130-X209W-249, 130-209-X249N/R, X130A-209-249, X130A-X209W-249, X130A-209-X249N/R, 130-X209W-X249N/R, X130A-X209W-X249N/R, 206-209-213, 206-X209W-213, 206-209-X213A, X206L/Y-209-213, 206-X209W-X213A, X206L/Y-X209W-213, X206L/Y-209-X213A, X206L/Y-X209W-X213A, 206-209-249, 206-X209W-249, 206-209-X249N/R, X206L/Y-209-249, X206L/Y-X209W-249, 206-X209W-X249N/R, X206L/Y-209-X249N/R, X206L/Y-X209W-X249N/R, 206-213-249, 206-X213A-249, 206-213-X249N/R X206L/Y-213-249, X206L/Y-X213A-249, X206L/Y-213-X249N/R, 206-X213A-X249N/R, X206L/Y-X213A-X249N/R, 209-213-249, X209W-213-249, 209-X213A-249, 209-213-X249N/R, X209W-X213A-249, X209W-213-X249N/R, 209-X213A-X249N/R, X209W-X213A-X249N/R, and combinations thereof, wherein X is any amino acid and said variant has proteolytic activity; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. Yet another embodiment provides an isolated subtilisin variant comprising an amino acid sequence comprising a combination of amino acid substitutions at two or more positions selected from: 78-X206L/Y, X78N-206, X78N-X206L/Y, 18-X78N, X18K/R-X78N, 18-X87R, X18K/R-X87R, 18-X206L/Y, X18K/R-X206L/Y, 24-X87R, X24F/P/R-X87R, 24-X206L/Y, X24F/P/R-206, X24F/P/R-X206L/Y, 24-X209W, X24F/P/R-X209W, X78N-87, X78N-X87D/R, 78-X129Q, X78N-X129Q, 78-X130A, X78N-130, X78N-209, 78-X209W, X78N-X209W, 78-X249N/R, X78N-249, X78N-X249N/R, 87-X206L/Y, X87D/R-X206L/Y, 87-X209W, X87D/R-X209W, 87-X213A, X87D/R-213, X87D/R-X213A, X87R-X249N/R, 129-X206L/Y, X129Q-206, X129Q-X206L/Y, 129-X209W, X129Q-X209W, 129-X249N/R, X129Q-249, X129Q-X249N/R, 130-X206L/Y, X130A-206, X130A-X206L/Y, 130-X209W, X130A-X209W, 130-X249N/R, X130A-249, X130A-X249N/R, 206-X209W, X206L/Y-209, X206L/Y-X209W, 206-X213A, X206L/Y-213, X206L/Y-X213A, X206L/Y-249, X206L/Y-X249N/R, X209W-213, X209W-X213A, X209W-249, X209W-X249N/R, 18-24-78, X18K/R-24-78, 18-X24F/P/R-78, 18-24-X78N, X18K/R-24-X78N, 18-X24F/P/R-X78N, X18K/R-X24F/P/R-78, X18K/R-X24F/P/R-X78N, 18-24-87, X18K/R-24-87, 18-X24F/P/R-87, 18-24-X87D/R, X18K/R-24-X87D/R, 18-X24F/P/R-X87D/R, X18K/R-X24F/P/R-87, X18K/R-X24F/P/R-X87D/R, 18-24-129, X18K/R-24-129, 18-X24F/P/R-129, 18-24-X129Q, X18K/R-X24F/P/R-129, X18K/R-24-X129Q, 18-X24F/P/R-X129Q, X18K/R-X24F/P/R-X129Q, 18-24-130, 18-X24F/P/R-130, 18-24-X130A, X18K/R-24-X130A, 18-X24F/P/R-X130A, X18K/R-X24F/P/R-X130A, 18-24-206, 18-24-X206L/Y, 18-X24F/P/R-206, X18K/R-24-206, X18K/R-24-X206L/Y, 18-X24F/P/R-X206L/Y, X18K/R-X24F/P/R-206, X18K/R-X24F/P/R-206L/Y, 18-24-209, 18-24-X209W, 18-X24F/P/R-209, X18K/R-24-209, X18K/R-24-X209W, 18-X24F/P/R-X209W, X18K/R-X24F/P/R-209, X18K/R-X24F/P/R-X209W, 18-78-87, 18-X78N-87, 18-78-X87D/R, X18K/R-78-87, X18K/R-X78N-87, X18K/R-78-X87D/R, 18-X78N-X87D/R, X18K/R-X78N-X87D/R, 18-78-129, 18-X78N-129, 18-78-X129Q, X18K/R-78-129, X18K/R-X78N-129, X18K/R-78-X129Q, 18-X78N-X129Q, X18K/R-X78N-X129Q, 18-78-130, 18-X78N-130, 18-78-X130A, X18K/R-78-130, X18K/R-X78N-130, X18K/R-78-X130A, 18-X78N-X130A, X18K/R-X78N-X130A, 18-78-206, 18-78-X206L/Y, 18-X78N-206, X18K/R-78-206, 18-X78N-X206L/Y, X18K/R-X78N-206, X18K/R-78-X206L/Y, X18K/R-X78N-X206L/Y, 18-78-209, 18-X78N-209, 18-78-X209W, X18K/R-78-209, X18K/R-78-X209W, 18-X78N-X209W, X18K/R-X78N-209, X18K/R-X78N-X209W, 18-78-213, 18-X78N-213, 18-78-X213A, X18K/R-78-213, 18-X78N-X213A, X18K/R-X78N-213, X18K/R-78-X213A, X18K/R-X78N-X213A, 18-78-249, 18-78-X249N/R, 18-X78N-249, X18K/R-78-249, 18-X78N-X249N/R, X18K/R-X78N-249, X18K/R-78-X249N/R, X18K/R-X78N-X249N/R, 18-87-129, X18K/R-87-129, 18-X87D/R-129, 18-87-X129Q, 18-X87D/R-X129Q, X18K/R-87-X129Q, X18K/R-X87D/R-129, X18K/R-X87D/R-X129Q, 18-87-130, X18K/R-87-130, 18-X87D/R-130, 18-87-X130A, 18-X87D/R-X130A, X18K/R-87-X130A, X18K/R-X87D/R-130, X18K/R-X87D/R-X130A, 18-87-206, X18K/R-87-206, 18-X87D/R-206, 18-87-X206L/Y, 18-X87D/R-X206L/Y, X18K/R-87-X206L/Y, X18K/R-X87D/R-206, X18K/R-X87D/R-X206L/Y, 18-87-209, X18K/R-87-209, 18-X87D/R-209, 18-87-X209W, 18-X87D/R-X209W, X18K/R-X87D/R-209, X18K/R-87-X209W, X18K/R-X87D/R-X209W, 18-X87D/R-213, 18-87-X213A, 18-X87D/R-X213A, X18K/R-X87D/R-213, X18K/R-87-X213A, X18K/R-X87D/R-X213A, 18-87-249, X18K/R-87-249, 18-X87D/R-249, 18-87-X249N/R, 18-X87D/R-X249N/R, 18K/R-X87D/R-249, 18K/R-87-X249N/R, 18K/R-X87D/R-X249N/R, 18-129-130, X18K/R-129-130, 18-X129Q-130, 18-129-X130A, X18K/R-X129Q-130, X18K/R-129-X130A, 18-X129Q-X130A, X18K/R-X129Q-X130A, 18-129-206, X18K/R-129-206, 18-X129Q-206, 18-129-X206L/Y, X18K/R-X129Q-206, X18K/R-129-X206L/Y, 18-X129Q-X206L/Y, X18K/R-X129Q-X206L/Y, 18-129-209, X18K/R-129-209, 18-X129Q-209, 18-129-X209W, X18K/R-X129Q-209, X18K/R-129-X209W, 18-X129Q-X209W, X18K/R-X129Q-X209W, 18-129-213, X18K/R-129-213, 18-X129Q-213, 18-129-X213A, X18K/R-X129Q-213, X18K/R-129-X213A, 18-X129Q-X213A, X18K/R-X129Q-X213A, 18-129-249, X18K/R-129-249, 18-X129Q-249, 18-129-X249N/R, X18K/R-X129Q-249, X18K/R-129-X249N/R, 18-X129Q-X249N/R, X18K/R-X129Q-X249N/R, 18-130-206, X18K/R-130-206, 18-X130A-206, 18-130-X206L/Y, X18K/R-X130A-206, X18K/R-130-X206L/Y, 18-X130A-X206L/Y, X18K/R-X130A-X206L/Y, 18-130-209, X18K/R-130-209, 18-X130A-209, 18-130-X209W, X18K/R-X130A-209, X18K/R-130-X209W, 18-X130A-X209W, X18K/R-X130A-X209W, 18-130-213, X18K/R-130-213, 18-X130A-213, 18-130-X213A, X18K/R-X130A-213, X18K/R-130-X213A, 18-X130A-X213A, X18K/R-X130A-X213A, 18-130-249, X18K/R-130-249, 18-X130A-249, 18-130-X249N/R, X18K/R-X130A-249, X18K/R-130-X249N/R, 18-X130A-X249N/R, X18K/R-X130A-X249N/R, 18-206-209, 18-206-X209W, 18-X206L/Y-209, X18K/R-206-209, 18-X206L/Y-X209W, X18K/R-206-X209W, X18K/R-X206L/Y-209, 18-206-213, X18K/R-206-213, 18-X206L/Y-213, 18-206-X213A, X18K/R-X206L/Y-213, X18K/R-206-X213A, 18-X206L/Y-X213A, X18K/R-X206L/Y-X213A, 18-206-249, X18K/R-206-249, 18-X206L/Y-249, 18-206-X249N/R, X18K/R-X206L/Y-249, X18K/R-206-X249N/R, 18-X206L/Y-X249N/R, X18K/R-X206L/Y-X249N/R, 18-209-213, 18-X209W-213, X18K/R-209-213, 18-209-X213A, 18-X209W-X213A, X18K/R-X209W-213, X18K/R-209-X213A, X18K/R-X209W-X213A, 18-209-249, 18-X209W-249, X18K/R-209-249, 18-209-X249N/R, 18-X209W-X249N/R, 18K/R-X209W-249, X18K/R-209-X249N/R, X18K/R-X209W-X249N/R, 18-213-X249N/R, X18K/R-X213A-249, X18K/R-213-X249N/R, 18-X213A-X249N/R, X18K/R-X213A-X249N/R, 24-78-87, 24-78-X87D/R, 24-X78N-87, X24F/P/R-78-87, 24-X78N-X87D/R, X24R/P/F-78-X87D/R, X24F/P/R-X78N-87, X24R/P/F-X78N-X87D/R, 24-78-129, X24F/P/R-78-129, 24-X78N-129, 24-78-X129Q, X24F/P/R-X78N-129, X24F/P/R-78-X129Q, 24-X78N-X129Q, X24F/P/R-X78N-X129Q, 24-78-130, X24F/P/R-78-130, 24-X78N-130, 24-78-X130A, X24F/P/R-X78N-130 X24F/P/R-78-X130A, 24-X78N-X130A, X24F/P/R-X78N-X130A, 24-78-X206L/Y, X24F/P/R-78-206, 24-X78N-X206L/Y, X24F/P/R-X78N-206, X24F/P/R-78-X206L/Y, X24F/P/R-X78N-X206L/Y, 24-78-209, X24F/P/R-78-209, 24-X78N-209, 24-78-X209W, X24F/P/R-X78N-209, X24F/P/R-78-X209W, 24-X78N-X209W, X24F/P/R-X78N-X209W, 24-78-213, X24F/P/R-78-213, 24-X78N-213, 24-78-X213A, X24F/P/R-X78N-213, X24F/P/R-78-X213A, 24-X78N-X213A, X24F/P/R-X78N-X213A, 24-78-X249N/R, 24-X78N-249, 24-X78N-X249N/R, X24F/P/R-X78N-249, X24F/P/R-78-X249N/R, X24F/P/R-X78N-X249N/R, 24-87-129, X24F/P/R-87-129, 24-X87D/R-129, 24-87-X129Q, X24F/P/R-X87D/R-129, X24F/P/R-87-X129Q, 24-X87D/R-X129Q, X24F/P/R-X87D/R-X129Q, 24-87-130, X24F/P/R-87-130, 24-X87D/R-130, 24-87-X130A, X24F/P/R-X87D/R-130, X24F/P/R-87-X130A, 24-X87D/R-X130A, X24F/P/R-X87D/R-X130A, 24-87-X206L/Y, 24-X87R-206, X24F/P/R-87-206, 24-X87D/R-X206L/Y, X24F/P/R-X87D/R-206, X24F/P/R-87-X206L/Y, X24F/P/R-X87D/R-X206L/Y, 24-87-X209W, X24F/P/R-87-X209W, 24-87-X209W, 24-87D/R-X209W, X24F/P/R-X87D/R-X209W, 24-X87D/R-213, 24-87-X213A, 24-X87D/R-X213A, X24F/P/R-X87D/R-213, X24F/P/R-87-X213A, X24F/P/R-X87D/R-X213A, 24-87-249, X24F/P/R-87-249, 24-X87D/R-249, 24-87-X249N/R, X24F/P/R-X87D/R-249, X24F/P/R-87-X249N/R, 24-X87D/R-X249N/R, X24F/P/R-X87D/R-X249N/R, 24-129-130, X24F/P/R-129-130, 24-X129Q-130, 24-129-X130A, X24F/P/R-X129Q-130, X24F/P/R-129-X130A, 24-X129Q-X130A, X24F/P/R-X129Q-X130A, 24-129-206, X24F/P/R-129-206, 24-X129Q-206, 24-129-X206L/Y, X24F/P/R-X129Q-206, X24F/P/R-129-X206L/Y, 24-X129Q-X206L/Y, X24F/P/R-X129Q-X206L/Y, 24-129-209, X24F/P/R-129-209, 24-X129Q-209, 24-129-X209W, X24F/P/R-X129Q-209, X24F/P/R-129-X209W, 24-X129Q-X209W, X24F/P/R-X129Q-X209W, 24-129-213, X24F/P/R-129-213, 24-X129Q-213, 24-129-X213A, X24F/P/R-X129Q-213, X24F/P/R-129-X213A, 24-X129Q-X213A, X24F/P/R-X129Q-X213A, 24-129-249, X24F/P/R-129-249, 24-X129Q-249, 24-129-X249N/R, X24F/P/R-X129Q-249, X24F/P/R-129-X249N/R, 24-X129Q-X249N/R, X24F/P/R-X129Q-X249N/R, 24-130-206, X24F/P/R-130-206, 24-X130A-206, 24-130-X206L/Y, X24F/P/R-X130A-206, X24F/P/R-130-X206L/Y, 24-X130A-X206L/Y, X24F/P/R-X130A-X206L/Y, 24-130-209, X24F/P/R-130-209, 24-X130A-209, 24-130-X209W, X24F/P/R-X130A-209, X24F/P/R-130-X209W, 24-X130A-X209W, X24F/P/R-

X130A-X209W, 24-130-213, X24F/P/R-130-213, 24-X130A-213, 24-130-X213A, X24F/P/R-X130A-213, X24F/P/R-X130-X213A, 24-X130A-X213A, X24F/P/R-X130A-X213A, 24-130-249, X24F/P/R-130-249, 24-X130A-249, 24-130-X249N/R, X24F/P/R-X130A-249, X24F/P/R-130-X249N/R, 24-X130A-X249N/R, X24F/P/R-X130A-X249N/R, 24-206-209, 24-206-X209W, 24-X206L/Y-209, 24F/P/R-206-209, 24-X206L/Y-X209W, X24F/P/R-X206L/Y-209, X24F/P/R-206-X209W, X24F/P/R-X206L/Y-X209W, 24-206-213, X24F/P/R-206-213, 24-X206L/Y-213, 24-206-X213A, X24F/P/R-X206L/Y-213, X24F/P/R-206-X213A, 24-X206L/Y-X213A, X24F/P/R-X206L/Y-X213A, 24-206-249, 24-X206L/Y-249, X24F/P/R-206-249, 24-206-X249N/R, 24-X206L/Y-X249N/R, X24F/P/R-X206L/Y-249, X24F/P/R-206-X249N/R, X24F/P/R-X206L/Y-X249N/R, 24-209-213, 24-X209W-213, X24F/P/R-209-213, 24-209-X213A, X24F/P/R-X209W-213, 24-X209W-X213A, X24F/P/R-209-X213A, X24F/P/R-X209W-X213A, 24-209-249, 24-X209W-249, X24F/P/R-209-249, 24-209-X249N/R, X24F/P/R-X209W-249, 24-X209W-X249N/R, X24F/P/R-209-X249N/R, X24F/P/R-X209W-X249N/R, 78-87-129, X78N-87-129, 78-X87D/R-129, 78-87-X129Q, X78N-X87D/R-129, X78N-87-X129Q, 78-X87D/R-X129Q, X78N-X87D/R-X129Q, 78-87-130, X78N-87-130, 78-X87D/R-130, 78-87-X130A, X78N-X87D/R-130, X78N-87-X130A, 78-X87D/R-X130A, X78N-X87D/R-X130A, 78-87-206, 78-87-X206L/Y, X78N-87-206, 78-X87D/R-206, 78-X87D/R-X206L/Y, X78N-87-X206L/Y, X78N-X87D/R-206, X78N-X87D/R-X206L/Y, 78-87-209, 78-87-X209W, X78N-87-209, 78-X87D/R-209, X78N-X87D/R-209, 78-X87D/R-X209W, X78N-87-X209W, X78N-X87D/R-X209W, 78-87-213, X78N-87-213, 78-X87D/R-213, 78-87-X213A, X78N-X87D/R-213, X78N-87-X213A, 78-X87D/R-X213A, X78N-X87D/R-X213A, 78-87-249, 78-87-X249N/R, X78N-87-249, 78-87D/R-249, X78N-X87D/R-249, 78-X87D/R-X249N/R, X78N-87-X249N/R, X78N-X87D/R-X249N/R, 78-129-130, X78N-129-130, 78-X129Q-130, 78-129-X130A, X78N-X129Q-130, X78N-129-X130A, 78-X129Q-X130A, X78N-X129Q-X130A, 78-129-206, X78N-129-206, 78-X129Q-206, 78-129-X206L/Y, X78N-X129Q-206, X78N-129-X206L/Y, 78-X129Q-X206L/Y, X78N-X129Q-X206L/Y, 78-129-209, X78N-129-209, 78-X129Q-209, 78-129-X209W, X78N-X129Q-209, X78N-129-X209W, 78-X129Q-X209W, X78N-X129Q-X209W, 78-129-213, X78N-129-213, 78-X129Q-213, 78-129-X213A, X78N-X129Q-213, X78N-129-X213A, 78-X129Q-X213A, X78N-X129Q-X213A, 78-129-249, X78N-129-249, 78-X129Q-249, 78-129-X249N/R, X78N-X129Q-249, X78N-129-X249N/R, 78-X129Q-X249N/R, X78N-X129Q-X249N/R, 78-130-206, X78N-130-206, 78-X130A-206, 78-130-X206L/Y, X78N-X130A-206, X78N-130-X206L/Y, 78-X130A-X206L/Y, X78N-X130A-X206L/Y, 78-130-209, X78N-130-209, 78-X130A-209, 78-130-X209W, X78N-X130A-209, X78N-130-X209W, 78-X130A-X209W, X78N-X130A-X209W, 78-130-213, X78N-130-213, 78-X130A-213, 78-130-X213A, X78N-X130A-213, X78N-130-X213A, 78-X130A-X213A, X78N-X130A-X213A, 78-130-213, X78N-130-213, 78-X130A-213, 78-130-X213A, X78N-X130A-213, X78N-130-X213A, 78-X130A-X213A, X78N-X130A-X213A, 78-130-249, X78N-130-249, 78-X130A-249, 78-130-X249N/R, X78N-X130A-249, X78N-130-X249N/R, 78-X130A-X249N/R, X78N-X130A-X249N/R, 78-206-209, 78-X206L/Y-209, 78-206-X209W, X78N-X206L/Y-209, X78N-206-X209W, 78-X206L/Y-X209W, X78N-X206L/Y-X209W, 78-206-213, X78N-206-213, 78-X206L/Y-213, 78-206-X213A, X78N-X206L/Y-213, X78N-206-X213A, 78-X206L/Y-X213A, X78N-X206L/Y-X213A, 78-206-249, 78-206-X249N/R, 78-X206L/Y-249, X78N-206-249, X78N-206-X249N/R, 78-X206L/Y-X249N/R, X78N-X206L/Y-249, X78N-X206L/Y-X249N/R, 78-209-213, 78-X209W-213, 78-209-X213A, X78N-209-213, X78N-X209W-213, X78N-209-X213A, 78-X209W-X213A, X78N-X209W-X213A, 78-209-249, 78-X209W-249, 78-209-X249N/R, X78N-209-249, 78-X209W-X249N/R, X78N-X209W-249, X78N-209-X249N/R, X78N-X209W-X249N/R, 78-213-249, 78-X213A-249, X78N-213-249, 78-213-X249N/R, X78N-X213A-249, X78N-213-X249N/R, 78-X213A-X249N/R, X78N-X213A-X249N/R, 87-129-130, X87D/R-129-130, 87-X129Q-130, 87-129-X130A, X87D/R-X129Q-130, X87D/R-129-X130A, 87-X129Q-X130A, X87D/R-X129Q-X130A, 87-129-206, X87D/R-129-206, 87-X129Q-206, 87-129-X206L/Y, X87D/R-X129Q-206, X87D/R-129-X206L/Y, 87-X129Q-X206L/Y, X87D/R-X129Q-X206L/Y, 87-129-209, X87D/R-129-209, 87-X129Q-209, 87-129-X209W, X87D/R-X129Q-209, X87D/R-129-X209W, 87-X129Q-X209W, X87D/R-X129Q-X209W, 87-129-213, X87D/R-129-213, 87-X129Q-213, 87-129-X213A, X87D/R-X129Q-213, X87D/R-129-X213A, 87-X129Q-X213A, X87D/R-X129Q-X213A, 87-129-249, X87D/R-129-249, 87-X129Q-249, 87-129-X249N/R, X87D/R-X129Q-249, X87D/R-129-X249N/R, 87-X129Q-X249N/R, X87D/R-X129Q-X249N/R, 87-130-206, X87D/R-130-206, 87-X130A-206, 87-130-X206L/Y, X87D/R-X130A-206, X87D/R-130-X206L/Y, 87-X130A-X206L/Y, X87D/R-X130A-X206L/Y, 87-130-209, X87D/R-130-209, 87-X130A-209, 87-130-X209W, X87D/R-X130A-209, X87D/R-130-X209W, 87-X130A-X209W, X87D/R-X130A-X209W, 87-130-213, X87D/R-130-213, 87-X130A-213, 87-130-X213A, X87D/R-X130A-213, X87D/R-130-X213A, 87-X130A-X213A, X87D/R-X130A-X213A, 87-130-249, X87D/R-130-249, 87-X130A-249, 87-130-X249N/R, X87D/R-X130A-249, X87D/R-130-X249N/R, 87-X130A-X249N/R, X87D/R-X130A-X249N/R, 87-206-209, X87D/R-206-209, 87-X206L/Y-209, 87-206-X209W, X87D/R-X206L/Y-209, X87D/R-206-X209W, 87-X206L/Y-X209W, X87D/R-X206L/Y-X209W, 87-206-213, X87D/R-206-213, 87-X206L/Y-213, 87-206-X213A, X87D/R-206-213, X87D/R-206-X213A, 87-X206L/Y-X213A, X87D/R-X206L/Y-X213A, 87-206-249, 87-X206L/Y-249, X87D/R-206-249, 87-209-X249N/R, X87R-206-X249N/R, X87D/R-X206L/Y-249, 87-X206L/Y-X249N/R, X87R-X206L/Y-X249N/R, 87-209-213, X87D/R-209-213, 87-X209W-213, 87-209-X213A, X87D/R-X209W-213, X87D/R-209-X213A, 87-X209W-X213A, X87D/R-X209W-X213A, 87-209-249, 87-X209W-249, 87-209-X249N/R, X87D/R-209-249, X87D/R-X209W-249, 87-X209W-X249N/R, X87R-209-X249N/R, X87D/R-X209W-X249N/R, 87-213-249, 87-X213A-249, X87D/R-213-249, 87-213-X249N/R, X87D/R-X213A-249, X87D/R-213-X249N/R, 87-X213A-X249N/R, X87D/R-X213A-X249N/R, 129-130-206, X129Q-130-206, 129-X130A-206, 129-130-X206L/Y, X129Q-X130A-206, X129Q-130-X206L/Y, 129-X130A-X206L/Y, X129Q-X130A-X206L/Y, 129-130-209, X129Q-130-209, 129-X130A-209, 129-130-X209W, X129Q-X130A-209, X129Q-130-X209W, 129-X130A-X209W, X129Q-X130A-X209W, 129-130-213, X129Q-130-213, 129-X130A-213, 129-130-X213A, X129Q-X130A-213, X129Q-130-X213A, 129-X130A-X213A, X129Q-X130A-X213A, 129-130-249, 129-X130A-249, 129-130-X249N/R, X129Q-X130A-249, X129Q-130-X249N/R, 129-X130A-X249N/R,

X129Q-X130A-X249N/R, 129-206-209, X129Q-206-209, 129-X206L/Y-209, 129-206-X209W, X129Q-X206L/Y-209, X129Q-206-X209W, 129-X206L/Y-X209W, X129Q-X206L/Y-X209W, 129-206-213, 129-X206L/Y-213, 129-206-X213A, X129Q-206-213, X129Q-X206L/Y-213, X129Q-206-X213A, 129-X206L/Y-X213A, X129Q-X206L/Y-X213A, 129-206-249, 129-X206L/Y-249, 129-206-X249N/R, X129Q-206-249, X129A-X206L/Y-249, X129Q-206-X249N/R, 129-X206L/Y-X249N/R, X129Q-X206L/Y-X249N/R, 129-209-213, 129-X209W-213, 129-209-X213A, X129Q-209-213, X129Q-X209W-213, X129Q-209-X213A, 129-X209W-X213A, X129Q-X209W-X213A, 129-209-249, 129-X209W-249, 129-209-X249N/R, X129Q-209-249, X129Q-X209W-249, X129Q-209-X249N/R, 129-X209W-X249N/R, X129Q-X209W-X249N/R, 129-213-249, 129-X213A-249, 129-213-X249N/R, X129Q-213-249, X129Q-X213A-249, 129-X213A-X249R, X129Q-213-X249N/R, X129Q-X213A-X249N/R, 130-206-209, X130A-206-209, 130-X206L/Y-209, 130-209-X209W, X130A-X206L/Y-209, X130A-206-X209W, 130-X206L/Y-X209W, X130A-X206L/Y-X209W, 130-206-213, 130-X206L/Y-213, 130-206-X213A, X130A-206-213, X130A-X206L/Y-213, X130A-206-X213A, X130A-X206L/Y-X213A, X130A-X206L/Y-X213A, 130-206-249, 130-X206L/Y-249, 130-206-X249N/R, X130A-206-249, X130A-X206L/Y-249, X130A-206-X249N/R, 130-X206L/Y-X249N/R, X130A-X206L/Y-X249N/R, 130-209-213, 130-X209W-213, 130-209-X213A, X130A-209-213, X130A-X209W-213, X130A-209-X213A, 130-X209W-X213A, X130A-X209W-X213A, 130-209-249, 130-X209W-249, 130-209-X249N/R, X130A-209-249, X130A-X209W-249, X130A-209-X249N/R, 130-X209W-X249N/R, X130A-X209W-X249N/R, 130-213-249, 130-X213A-249, 130-213-X249N/R, X130A-213-249, X130A-X213A-249, 130-X213A-X249R, X130A-213-X249N/R, X130A-X213A-X249N/R, 130-209-249, 130-X209W-249, 130-209-X249N/R, X130A-209-249, X130A-X209W-249, X130A-209-X249N/R, 130-X209W-X249N/R, X130A-X209W-X249N/R, 206-209-213, 206-X209W-213, 206-209-X213A, X206L/Y-209-213, 206-X209W-X213A, X206L/Y-X209W-213, X206L/Y-209-X213A, X206L/Y-X209W-X213A, 206-209-249, 206-X209W-249, 206-209-X249N/R, X206L/Y-209-249, X206L/Y-X209W-249, 206-X209W-X249N/R, X206L/Y-209-X249N/R, X206L/Y-X209W-X249N/R, 206-213-249, 206-X213A-249, 206-213-X249N/R X206L/Y-213-249, X206L/Y-X213A-249, X206L/Y-213-X249N/R, 206-X213A-X249N/R, X206L/Y-X213A-X249N/R, 209-213-249, X209W-213-249, 209-X213A-249, 209-213-X249N/R, X209W-X213A-249, X209W-213-X249N/R, 209-X213A-X249N/R, X209W-X213A-X249N/R, and combinations thereof, wherein X is any amino acid, said variant has proteolytic activity, and the amino acid sequence of said variant further comprises one or more substitutions selected from: (i) 1, 3, 9, 16, 20, 22, 28, 42, 43, 44, 56, 76, 77, 99, 100, 101, 103, 104, 108, 116, 118, 120, 124, 127, 128, 150, 158, 159, 166, 185, 188, 194, 204, 212, 217,218, 222, 232, 235, 243, 245, 246, 251, 254,259, 268, and 270, (ii) X1V, X3T/V, X9G, X16T, X20E/R, X22L, X28T, X42I, X43R/S, X44V, X56P, X76D, X77D, X99N, X100S, X101F/G/H/T/V, X103A/D/P, X104I, X108S, X116L/M, X118R/V, X120R, X124M, X127T, X128L, X150T, X158E/T/V, X159D, X166D/N, X185Y, X188D, X194D, X204D, X212D, X217K, X218S, X222L/Q/S, X232V, X235T, X243S, X245R, X246V, X251R, X254T, X259G, X268A, and X270P/T, or (iii) A1V, S3T/V, S9G, A16T, G20E/R, T22L, V28T, L42I, N43R/S, I44V, S56P, N76D, N77D, S99N, G100S, S101F/G/H/T/V, S103A/D/P, V104I, A108S, N116L/M, G118R/V, H120R, L124M, G127T, S128L, V150T, A158E/T/V, G159D, S166D/N, N185Y, S188D, A194D, N204D, S212D, L217K, N218S, M222L/Q/S, A232V, K235T, N243S, Q245R, I246V, K251R, A254T, S259G, V268A, and A270P/T; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. Still yet another embodiment provides an isolated subtilisin variant comprising an amino acid sequence comprising a combination of amino acid substitutions at two or more positions selected from: 78-X206L/Y, X78N-206, X78N-X206L/Y, 18-X78N, X18K/R-X78N, 18-X87R, X18K/R-X87R, 18-X206L/Y, X18K/R-X206L/Y, 24-X87R, X24F/P/R-X87R, 24-X206L/Y, X24F/P/R-206, X24F/P/R-X206L/Y, 24-X209W, X24F/P/R-X209W, X78N-87, X78N-X87D/R, 78-X129Q, X78N-X129Q, 78-X130A, X78N-130, X78N-209, 78-X209W, X78N-X209W, 78-X249N/R, X78N-249, X78N-X249N/R, 87-X206L/Y, X87D/R-X206L/Y, 87-X209W, X87D/R-X209W, 87-X213A, X87D/R-213, X87D/R-X213A, X87R-X249N/R, 129-X206L/Y, X129Q-206, X129Q-X206L/Y, 129-X209W, X129Q-X209W, 129-X249N/R, X129Q-249, X129Q-X249N/R, 130-X206L/Y, X130A-206, X130A-X206L/Y, 130-X209W, X130A-X209W, 130-X249N/R, X130A-249, X130A-X249N/R, 206-X209W, X206L/Y-209, X206L/Y-X209W, 206-X213A, X206L/Y-213, X206L/Y-X213A, X206L/Y-249, X206L/Y-X249N/R, X209W-213, X209W-X213A, X209W-249, X209W-X249N/R, 18-24-78, X18K/R-24-78, 18-X24F/P/R-78, 18-24-X78N, X18K/R-24-X78N, 18-X24F/P/R-X78N, X18K/R-X24F/P/R-78, X18K/R-X24F/P/R-X78N, 18-24-87, X18K/R-24-87, 18-X24F/P/R-87, 18-24-X87D/R, X18K/R-24-X87D/R, 18-X24F/P/R-X87D/R, X18K/R-X24F/P/R-87, X18K/R-X24F/P/R-X87D/R, 18-24-129, X18K/R-24-129, 18-X24F/P/R-129, 18-24-X129Q, X18K/R-X24F/P/R-129, X18K/R-24-X129Q, 18-X24F/P/R-X129Q, X18K/R-X24F/P/R-X129Q, 18-24-130, 18-X24F/P/R-130, 18-24-X130A, X18K/R-24-130, X18K/R-X24F/P/R-130, X18K/R-24-X130A, 18-X24F/P/R-X130A, X18K/R-X24F/P/R-X130A, 18-24-206, 18-24-X206L/Y, 18-X24F/P/R-206, X18K/R-24-206, X18K/R-24-X206L/Y, 18-X24F/P/R-X206L/Y, X18K/R-X24F/P/R-206, X18K/R-X24F/P/R-X206L/Y, 18-24-209, 18-24-X209W, 18-X24F/P/R-209, X18K/R-24-209, X18K/R-24-X209W, 18-X24F/P/R-X209W, X18K/R-X24F/P/R-209, X18K/R-X24F/P/R-X209W, 18-78-87, 18-X78N-87, 18-78-X87D/R, X18K/R-78-87, X18K/R-X78N-87, X18K/R-78-X87D/R, 18-X78N-X87D/R, X18K/R-X78N-X87D/R, 18-78-129, 18-X78N-129, 18-78-X129Q, X18K/R-78-129, X18K/R-X78N-129, X18K/R-78-X129Q, 18-X78N-X129Q, X18K/R-X78N-X129Q, 18-78-130, 18-X78N-130, 18-78-X130A, X18K/R-78-130, X18K/R-X78N-130, X18K/R-78-X130A, 18-X78N-X130A, X18K/R-X78N-X130A, 18-78-206, 18-78-X206L/Y, 18-X78N-206, X18K/R-78-206, 18-X78N-X206L/Y, X18K/R-X78N-206, X18K/R-78-X206L/Y, X18K/R-X78N-X206L/Y, 18-78-209, 18-X78N-209, 18-78-X209W, X18K/R-78-209, X18K/R-78-X209W, 18-X78N-X209W, X18K/R-X78N-209, X18K/R-X78N-X209W, 18-78-213, 18-X78N-213, 18-78-X213A, X18K/R-78-213, 18-X78N-X213A, X18K/R-X78N-213, X18K/R-78-X213A, X18K/R-X78N-X213A, 18-78-249, 18-78-X249N/R, 18-X78N-249, X18K/R-78-249, 18-X78N-X249N/R, X18K/R-X78N-249, X18K/R-78-X249N/R, X18K/R-X78N-X249N/R, 18-87-129, X18K/R-87-129, 18-X87D/R-129, 18-87-X129Q, 18-X87D/R-

X129Q, X18K/R-87-X129Q, X18K/R-X87D/R-129, X18K/R-X87D/R-X129Q, 18-87-130, X18K/R-87-130, 18-X87D/R-130, 18-87-X130A, 18-X87D/R-X130A, X18K/R-87-X130A, X18K/R-X87D/R-130, X18K/R-X87D/R-X130A, 18-87-206, X18K/R-87-206, 18-X87D/R-206, 18-87-X206L/Y, 18-X87D/R-X206L/Y, X18K/R-87-X206L/Y, X18K/R-X87D/R-206, X18K/R-X87D/R-X206L/Y, 18-87-209, X18K/R-87-209, 18-X87D/R-209, 18-87-X209W, 18-X87D/R-X209W, X18K/R-X87D/R-209, X18K/R-87-X209W, X18K/R-X87D/R-X209W, 18-X87D/R-213, 18-87-X213A, 18-X87D/R-X213A, X18K/R-X87D/R-213, X18K/R-87-X213A, X18K/R-X87D/R-X213A, 18-87-249, X18K/R-87-249, 18-X87D/R-249, 18-87-X249N/R, 18-X87D/R-249N/R, 18K/R-X87D/R-249, 18K/R-87-X249N/R, 18K/R-X87D/R-X249N/R, 18-129-130, X18K/R-129-130, 18-X129Q-130, 18-129-X130A, X18K/R-X129Q-130, X18K/R-129-X130A, 18-X129Q-X130A, X18K/R-X129Q-X130A, 18-129-206, X18K/R-129-206, 18-X129Q-206, 18-129-X206L/Y, X18K/R-X129Q-206, X18K/R-129-X206L/Y, 18-X129Q-X206L/Y, X18K/R-X129Q-X206L/Y, 18-129-209, X18K/R-129-209, 18-X129Q-209, 18-129-X209W, X18K/R-X129Q-209, X18K/R-129-X209W, 18-X129Q-X209W, X18K/R-X129Q-X209W, 18-129-213, X18K/R-129-213, 18-X129Q-213, 18-129-X213A, X18K/R-X129Q-213, X18K/R-129-X213A, 18-X129Q-X213A, X18K/R-X129Q-X213A, 18-129-249, X18K/R-129-249, 18-X129Q-249, 18-129-X249N/R, X18K/R-X129Q-249, X18K/R-129-X249N/R, 18-X129Q-X249N/R, X18K/R-X129Q-X249N/R, 18-130-206, X18K/R-130-206, 18-X130A-206, 18-130-X206L/Y, X18K/R-X130A-206, X18K/R-130-X206L/Y, 18-X130A-X206L/Y, X18K/R-X130A-X206L/Y, 18-130-209, X18K/R-130-209, 18-X130A-209, 18-130-X209W, X18K/R-X130A-209, X18K/R-130-X209W, 18-X130A-X209W, X18K/R-X130A-X209W, 18-130-213, X18K/R-130-213, 18-X130A-213, 18-130-X213A, X18K/R-X130A-213, X18K/R-130-X213A, 18-X130A-X213A, X18K/R-X130A-X213A, 18-130-249, X18K/R-130-249, 18-X130A-249, 18-130-X249N/R, X18K/R-X130A-249, X18K/R-130-X249N/R, 18-X130A-X249N/R, X18K/R-X130A-X249N/R, 18-206-209, 18-206-X209W, 18-X206L/Y-209, 18K/R-206-209, 18-X206L/Y-X209W, X18K/R-X206L/Y-209, X18K/R-206-X209W, X18K/R-X206L/Y-X209W, 18-206-213, X18K/R-206-213, 18-206L/Y-213, 18-206-X213A, X18K/R-X206L/Y-213, X18K/R-206-X213A, 18-X206L/Y-X213A, X18K/R-X206L/Y-X213A, 18-206-249, X18K/R-206-249, 18-206L/Y-249, 18-206-X249N/R, X18K/R-X206L/Y-249, X18K/R-206-X249N/R, 18-X206L/Y-X249N/R, X18K/R-X206L/Y-X249N/R, 18-209-213, 18-X209W-213, X18K/R-209-213, 18-209-X213A, 18-X209W-X213A, X18K/R-X209W-213, X18K/R-209-X213A, X18K/R-X209W-X213A, 18-209-249, 18-X209W-249, X18K/R-209-249, 18-209-X249N/R, 18-X209W-X249N/R, 18K/R-X209W-249, X18K/R-209-X249N/R, X18K/R-X209W-X249N/R, 18-213-X249N/R, X18K/R-X213A-249, X18K/R-213-X249N/R, 18-X213A-X249N/R, X18K/R-X213A-X249N/R, 24-78-87, 24-78-X87D/R, 24-X78N-87, X24F/P/R-78-87, 24-X78N-X87D/R, X24R/P/F-78-X87D/R, X24F/P/R-X78N-87, X24R/P/F-X78N-X87D/R, 24-78-129, X24F/P/R-78-129, 24-X78N-129, 24-78-X129Q, X24F/P/R-X78N-129, X24F/P/R-78-X129Q, 24-X78N-X129Q, X24F/P/R-X78N-X129Q, 24-78-130, X24F/P/R-78-130, 24-X78N-130, 24-78-X130A, X24F/P/R-X78N-130 X24F/P/R-78-X130A, 24-X78N-X130A, X24F/P/R-X78N-X130A, 24-78-X206L/Y, X24F/P/R-78-206, 24-X78N-X206L/Y, X24F/P/R-X78N-206, X24F/P/R-78-X206L/Y, X24F/P/R-X78N-X206L/Y, 24-78-209, X24F/P/R-78-209, 24-X78N-209, 24-78-X209W, X24F/P/R-X78N-209, X24F/P/R-78-X209W, 24-X78N-X209W, X24F/P/R-X78N-X209W, 24-78-213, X24F/P/R-78-213, 24-X78N-213, 24-78-X213A, X24F/P/R-X78N-213, X24F/P/R-78-X213A, 24-X78N-X213A, X24F/P/R-X78N-X213A, 24-78-X249N/R, 24-X78N-249, 24-X78N-X249N/R, X24F/P/R-X78N-249, X24F/P/R-78-X249N/R, X24F/P/R-X78N-X249N/R, 24-87-129, X24F/P/R-87-129, 24-X87D/R-129, 24-87-X129Q, X24F/P/R-X87D/R-129, X24F/P/R-87-X129Q, 24-X87D/R-X129Q, X24F/P/R-X87D/R-X129Q, 24-87-130, X24F/P/R-87-130, 24-X87D/R-130, 24-87-X130A, X24F/P/R-X87D/R-130, X24F/P/R-87-X130A, 24-X87D/R-X130A, X24F/P/R-X87D/R-X130A, 24-87-X206L/Y, 24-X87R-206, X24F/P/R-87-206, 24-X87D/R-X206L/Y, X24F/P/R-X87D/R-206, X24F/P/R-87-X206L/Y, X24F/P/R-X87D/R-X206L/Y, 24-87-X209W, X24F/P/R-87-X209W, 24-87-X209W, 24-87D/R-X209W, X24F/P/R-X87D/R-X209W, 24-X87D/R-213, 24-87-X213A, 24-X87D/R-X213A, X24F/P/R-X87D/R-213, X24F/P/R-87-X213A, X24F/P/R-X87D/R-X213A, 24-87-249, X24F/P/R-87-249, 24-X87D/R-249, 24-87-X249N/R, X24F/P/R-X87D/R-249, X24F/P/R-87-X249N/R, X24-X87D/R-X249N/R, X24F/P/R-X87D/R-X249N/R, 24-129-130, X24F/P/R-129-130, 24-X129Q-130, 24-129-X130A, X24F/P/R-X129Q-130, X24F/P/R-129-X130A, 24-X129Q-X130A, X24F/P/R-X129Q-X130A, 24-129-206, X24F/P/R-129-206, 24-X129Q-206, 24-129-X206L/Y, X24F/P/R-X129Q-206, X24F/P/R-129-X206L/Y, 24-X129Q-X206L/Y, X24F/P/R-X129Q-X206L/Y, 24-129-209, X24F/P/R-129-209, 24-X129Q-209, 24-129-X209W, X24F/P/R-X129Q-209, X24F/P/R-129-X209W, 24-X129Q-X209W, X24F/P/R-X129Q-X209W, 24-129-213, X24F/P/R-129-213, 24-X129Q-213, 24-129-X213A, X24F/P/R-X129Q-213, X24F/P/R-129-X213A, 24-X129Q-X213A, X24F/P/R-X129Q-X213A, 24-129-249, X24F/P/R-129-249, 24-X129Q-249, 24-129-X249N/R, X24F/P/R-X129Q-249, X24F/P/R-129-X249N/R, 24-X129Q-X249N/R, X24F/P/R-X129Q-X249N/R, 24-130-206, X24F/P/R-130-206, 24-X130A-206, 24-130-X206L/Y, X24F/P/R-X130A-206, X24F/P/R-130-X206L/Y, 24-X130A-X206L/Y, X24F/P/R-X130A-X206L/Y, 24-130-209, X24F/P/R-130-209, 24-X130A-209, 24-130-X209W, X24F/P/R-X130A-209, X24F/P/R-130-X209W, 24-X130A-X209W, X24F/P/R-X130A-X209W, 24-130-213, X24F/P/R-130-213, 24-X130A-213, 24-130-X213A, X24F/P/R-X130A-213, X24F/P/R-130-X213A, 24-X130A-X213A, X24F/P/R-X130A-X213A, 24-130-249, X24F/P/R-130-249, 24-X130A-249, 24-130-X249N/R, X24F/P/R-X130A-249, X24F/P/R-130-X249N/R, 24-X130A-X249N/R, X24F/P/R-X130A-X249N/R, 24-206-209, 24-206-X209W, 24-X206L/Y-209, 24F/P/R-206-209, 24-X206L/Y-X209W, X24F/P/R-X206L/Y-209, X24F/P/R-206-X209W, X24F/P/R-X206L/Y-X209W, 24-206-213, X24F/P/R-206-213, 24-X206L/Y-213, 24-206-X213A, X24F/P/R-X206L/Y-213, X24F/P/R-206-X213A, 24-X206L/Y-X213A, X24F/P/R-X206L/Y-X213A, 24-206-249, X24F/P/R-X206L/Y-249, X24F/P/R-206-249, 24-206-X249N/R, 24-X206L/Y-X249N/R, X24F/P/R-X206L/Y-249, X24F/P/R-206-X249N/R, X24F/P/R-X206L/Y-X249N/R, 24-209-213, 24-X209W-213, X24F/P/R-209-213, 24-209-X213A, X24F/P/R-X209W-213, 24-X209W-X213A, X24F/P/R-209-X213A, X24F/P/R-X209W-X213A, 24-209-249, X24F/P/R-209-249, X24F/P/R-209-249, 24-209-X249N/R, X24F/P/R-X209W-249, 24-X209W-X249N/R, X24F/P/R-209-X249N/R, X24F/P/R-X209W-X249N/R, 78-87-129, X78N-87-129, 78-X87D/R-129, 78-87-X129Q, X78N-X87D/R-129, X78N-87-

X129Q, 78-X87D/R-X129Q, X78N-X87D/R-X129Q, 78-87-130, X78N-87-130, 78-X87D/R-130, 78-87-X130A, X78N-X87D/R-130, X78N-87-X130A, 78-X87D/R-X130A, X78N-X87D/R-X130A, 78-87-206, 78-87-X206L/Y, X78N-87-206, 78-X87D/R-206, 78-X87D/R-X206L/Y, X78N-87-X206L/Y, X78N-X87D/R-206, X78N-X87D/R-X206L/Y, 78-87-209, 78-87-X209W, X78N-87-209, 78-X87D/R-209, X78N-X87D/R-209, 78-X87D/R-X209W, X78N-87-X209W, X78N-X87D/R-X209W, 78-87-213, X78N-87-213, 78-X87D/R-213, 78-87-X213A, X78N-X87D/R-213, X78N-87-X213A, 78-X87D/R-X213A, X78N-X87D/R-X213A, 78-87-249, 78-87-X249N/R, X78N-87-249, 78-87D/R-249, X78N-X87D/R-249, 78-X87D/R-X249N/R, X78N-87-X249N/R, X78N-X87D/R-X249N/R, 78-129-130, X78N-129-130, 78-X129Q-130, 78-129-X130A, X78N-X129Q-130, X78N-129-X130A, 78-X129Q-X130A, X78N-X129Q-X130A, 78-129-206, X78N-129-206, 78-X129Q-206, 78-129-X206L/Y, X78N-X129Q-206, X78N-129-X206L/Y, 78-X129Q-X206L/Y, X78N-X129Q-X206L/Y, 78-129-209, X78N-129-209, 78-X129Q-209, 78-129-X209W, X78N-X129Q-209, X78N-129-X209W, 78-X129Q-X209W, X78N-X129Q-X209W, 78-129-213, X78N-129-213, 78-X129Q-213, 78-129-X213A, X78N-129-213, X78N-X129Q-213, X78N-129-X213A, 78-X129Q-X213A, X78N-X129Q-X213A, 78-129-249, X78N-129-249, 78-X129Q-249, 78-129-X249N/R, X78N-X129Q-249, X78N-129-X249N/R, 78-X129Q-X249N/R, X78N-X129Q-X249N/R, 78-130-206, X78N-130-206, 78-X130A-206, 78-130-X206L/Y, X78N-X130A-206, X78N-130-X206L/Y, 78-X130A-X206L/Y, X78N-X130A-X206L/Y, 78-130-209, X78N-130-209, 78-X130A-209, 78-130-X209W, X78N-X130A-209, X78N-130-X209W, 78-X130A-X209W, X78N-X130A-X209W, 78-130-213, X78N-130-213, 78-X130A-213, 78-130-X213A, X78N-X130A-213, X78N-130-X213A, 78-X130A-X213A, X78N-X130A-X213A, 78-130-213, X78N-130-213, 78-X130A-213, 78-130-X213A, X78N-X130A-213, X78N-130-X213A, 78-X130A-X213A, X78N-X130A-X213A, 78-130-249, X78N-130-249, 78-X130A-249, 78-130-X249N/R, X78N-X130A-249, X78N-130-X249N/R, 78-X130A-X249N/R, X78N-X130A-X249N/R, 78-206-209, X78N-206-209, 78-X206L/Y-209, 78-206-X209W, X78N-X206L/Y-209, X78N-206-X209W, 78-X206L/Y-X209W, X78N-X206L/Y-X209W, 78-206-213, X78N-206-213, 78-X206L/Y-213, 78-206-X213A, X78N-X206L/Y-213, X78N-206-X213A, 78-X206L/Y-X213A, X78N-X206L/Y-X213A, 78-206-249, 78-206-X249R/N, 78-X206L/Y-249, X78N-206-249, X78N-206-X249N/R, 78-X206L/Y-X249N/R, X78N-X206L/Y-249, X78N-X206L/Y-X249N/R, 78-209-213, 78-X209W-213, 78-209-X213A, X78N-209-213, X78N-X209W-213, X78N-209-X213A, 78-X209W-X213A, X78N-X209W-X213A, 78-209-249, 78-X209W-249, 78-209-X249N/R, X78N-209-249, 78-X209W-X249N/R, X78N-X209W-249, X78N-209-X249N/R, X78N-X209W-X249N/R, 78-213-249, 78-X213A-249, X78N-213-249, 78-213-X249N/R, X78N-X213A-249, X78N-213-X249N/R, 78-X213A-X249N/R, X78N-X213A-X249N/R, 87-129-130, X87D/R-129-130, 87-X129Q-130, 87-129-X130A, X87D/R-X129Q-130, X87D/R-129-X130A, 87-X129Q-X130A, X87D/R-X129Q-X130A, 87-129-206, X87D/R-129-206, 87-X129Q-206, 87-129-X206L/Y, X87D/R-X129Q-206, X87D/R-129-X206L/Y, 87-X129Q-X206L/Y, X87D/R-X129Q-X206L/Y, 87-129-209, 87-X129Q-209, 87-129-X209W, X87D/R-X129Q-209, X87D/R-129-X209W, 87-X129Q-X209W, X87D/R-X129Q-X209W, 87-129-213, X87D/R-129-213, 87-X129Q-213, 87-129-X213A, X87D/R-X129Q-213, 87-X129Q-X213A, X87D/R-X129Q-X213A, 87-129-249, X87D/R-129-249, 87-X129Q-249, 87-129-X249N/R, X87D/R-X129Q-249, X87D/R-129-X249N/R, 87-X129Q-X249N/R, X87D/R-X129Q-X249N/R, 87-130-206, X87D/R-130-206, 87-X130A-206, 87-130-X206L/Y, X87D/R-X130A-206, X87D/R-130-X206L/Y, 87-X130A-X206L/Y, X87D/R-X130A-X206L/Y, 87-130-209, X87D/R-130-209, 87-X130A-209, 87-130-X209W, X87D/R-X130A-209, X87D/R-130-X209W, 87-X130A-X209W, X87D/R-X130A-X209W, 87-130-213, X87D/R-130-213, 87-X130A-213, 87-130-X213A, X87D/R-X130A-213, X87D/R-130-X213A, 87-X130A-X213A, X87D/R-X130A-X213A, 87-130-249, X87D/R-130-249, 87-X130A-249, 87-130-X249N/R, X87D/R-X130A-249, X87D/R-130-X249N/R, 87-X130A-X249N/R, X87D/R-X130A-X249N/R, 87-206-209, X87D/R-206-209, 87-X206L/Y-209, 87-206-X209W, X87D/R-X206L/Y-209, X87D/R-206-X209W, 87-X206L/Y-X209W, X87D/R-X206L/Y-X209W, 87-206-213, 87-X206L/Y-213, 87-206-X213A, X87D/R-206-213, X87D/R-X206L/Y-213, X87D/R-206-X213A, 87-X206L/Y-X213A, X87D/R-X206L/Y-X213A, 87-206-249, 87-X206L/Y-249, 87D/R-206-249, 87-209-X249N/R, X87R-206-X249N/R, X87D/R-X206L/Y-249, 87-X206L/Y-X249N/R, X87R-X206L/Y-X249N/R, 87-209-213, X87D/R-209-213, 87-X209W-213, 87-209-X213A, X87D/R-X209W-213, X87D/R-209-X213A, 87-X209W-X213A, X87D/R-X209W-X213A, 87-209-249, 87-X209W-249, 87-209-X249N/R, X87D/R-209-249, X87D/R-X209W-249, 87-X209W-X249N/R, X87R-209-X249N/R, X87D/R-X209W-X249N/R, 87-213-249, 87-X213A-249, X87D/R-213-249, 87-213-X249N/R, X87D/R-X213A-249, X87D/R-213-X249N/R, 87-X213A-X249N/R, X87D/R-X213A-X249N/R, 129-130-206, X129Q-130-206, 129-X130A-206, 129-130-X206L/Y, X129Q-X130A-206, X129Q-130-X206L/Y, 129-X130A-X206L/Y, X129Q-X130A-X206L/Y, 129-130-209, X129Q-130-209, 129-X130A-209, 129-130-X209W, X129Q-X130A-209, X129Q-130-X209W, 129-X130A-X209W, X129Q-X130A-X209W, 129-130-213, X129Q-130-213, 129-X130A-213, 129-130-X213A, X129Q-X130A-213, X129Q-130-X213A, 129-X130A-X213A, X129Q-X130A-X213A, 129-130-249, X129Q-130-249, 129-X130A-249, 129-130-X249N/R, X129Q-X130A-249, X129Q-130-X249N/R, 129-X130A-X249N/R, X129Q-X130A-X249N/R, 129-206-209, X129Q-206-209, 129-X206L/Y-209, 129-206-X209W, X129Q-X206L/Y-209, X129Q-206-X209W, 129-X206L/Y-X209W, X129Q-X206L/Y-X209W, 129-206-213, 129-X206L/Y-213, 129-206-X213A, X129Q-206-213, X129Q-X206L/Y-213, X129Q-206-X213A, 129-X206L/Y-X213A, X129Q-X206L/Y-X213A, 129-206-249, 129-X206L/Y-249, 129-206-X249N/R, X129Q-206-249, X129A-X206L/Y-249, X129Q-206-X249N/R, 129-X206L/Y-X249N/R, X129Q-X206L/Y-X249N/R, 129-209-213, 129-X209W-213, 129-209-X213A, X129Q-209-213, X129Q-X209W-213, X129Q-209-X213A, 129-X209W-X213A, X129Q-X209W-X213A, 129-209-249, 129-X209W-249, 129-209-X249N/R, X129Q-209-249, X129Q-X209W-249, X129Q-209-X249N/R, 129-X209W-X249N/R, X129Q-X209W-X249N/R, 129-213-249, 129-X213A-249, 129-213-X249N/R, X129Q-213-249, X129Q-X213A-249, 129-X213A-X249R, X129Q-213-X249N/R, X129Q-X213A-X249N/R, 130-206-209, X130A-206-209, 130-X206L/Y-209, 130-206-X209W, X130A-X206L/Y-209, X130A-206-X209W, 130-X206L/Y-X209W, X130A-X206L/Y-X209W, 130-206-213, 130-X206L/Y-213, 130-206-X213A, X130A-X206L/Y-213, X130A-206-X213A, 130-X206L/Y-

X213A, X130A-X206L/Y-X213A, 130-206-249, 130-X206L/Y-249, 130-206-X249N/R, X130A-206-249, X130A-X206L/Y-249, X130A-206-X249N/R, 130-X206L/Y-X249N/R, X130A-X206L/Y-X249N/R, 130-209-213, 130-X209W-213, 130-209-X213A, X130A-209-213, X130A-X209W-213, X130A-209-X213A, 130-X209W-X213A, X130A-X209W-X213A, 130-209-249, 130-X209W-249, 130-209-X249N/R, X130A-209-249, X130A-X209W-249, X130A-209-X249N/R, 130-X209W-X249N/R, X130A-X209W-X249N/R, 130-213-249, 130-X213A-249, 130-213-X249N/R, X130A-213-249, X130A-X213A-249, 130-X213A-X249R, X130A-213-X249N/R, X130A-X213A-X249N/R, 130-209-249, 130-X209W-249, 130-209-X249N/R, X130A-209-249, X130A-X209W-249, X130A-209-X249N/R, 130-X209W-X249N/R, X130A-X209W-X249N/R, 206-209-213, 206-X209W-213, 206-209-X213A, X206L/Y-209-213, 206-X209W-X213A, X206L/Y-X209W-213, X206L/Y-209-X213A, X206L/Y-X209W-X213A, 206-209-249, 206-X209W-249, 206-209-X249N/R, X206L/Y-209-249, X206L/Y-X209W-249, 206-X209W-X249N/R, X206L/Y-209-X249N/R, X206L/Y-X209W-X249N/R, 206-213-249, 206-X213A-249, 206-213-X249N/R X206L/Y-213-249, X206L/Y-X213A-249, X206L/Y-213-X249N/R, 206-X213A-X249N/R, X206L/Y-X213A-X249N/R, 209-213-249, X209W-213-249, 209-X213A-249, 209-213-X249N/R, X209W-X213A-249, X209W-213-X249N/R, 209-X213A-X249N/R, X209W-X213A-X249N/R, and combinations thereof, wherein X is any amino acid, said variant has proteolytic activity, and the amino acid sequence of said variant further comprises one or more substitutions selected from: (i) 3, 28, 43, 76, 99, 100, 101, 103, 104, 108, 116, 118, 124, 127, 128, 150, 158, 159, 166, 188, 194, 212, 217, 222, 232, 235, 243, 245, 246, and 270, (ii) X3T/V, X28T, X43S, X76D, X99N, X100S, X101F/G/V, X103A/D/P, X104I, X108S, X116M, X118R, X124M, X127T, X128L, X150T, X158E/T, X159D, X166D, X188D, X194D, X212D, X217K, X222Q/S, X232V, X235T, X243S, X245R, X246V, and X270T, or (iii) S3V/T, V28T, N43S, N76D, S99N, G100S, S101F/G/V, S103A/D/P, V104I, A108S, N116M, G118R, L124M, G127T, S128L, V150T, A158E/T, G159D, S166D, S188D, A194D, S212D, L217K, M222Q/S, A232V, K235T, N243S, Q245R, I246V, and A270T; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. An even still yet further embodiment provides an isolated subtilisin variant comprising an amino acid sequence comprising a combination of amino acid substitutions at two or more positions selected from: 78-X206L/Y, X78N-206, X78N-X206L/Y, 18-X78N, X18K/R-X78N, 18-X87R, X18K/R-X87R, 18-X206L/Y, X18K/R-X206L/Y, 24-X87R, X24F/P/R-X87R, 24-X206L/Y, X24F/P/R-206, X24F/P/R-X206L/Y, 24-X209W, X24F/P/R-X209W, X78N-87, X78N-X87D/R, 78-X129Q, X78N-X129Q, 78-X130A, X78N-130, X78N-209, 78-X209W, X78N-X209W, 78-X249N/R, X78N-249, X78N-X249N/R, 87-X206L/Y, X87D/R-X206L/Y, 87-X209W, X87D/R-X209W, 87-X213A, X87D/R-213, X87D/R-X213A, X87R-X249N/R, 129-X206L/Y, X129Q-206, X129Q-X206L/Y, 129-X209W, X129Q-X209W, 129-X249N/R, X129Q-249, X129Q-X249N/R, 130-X206L/Y, X130A-206, X130A-X206L/Y, 130-X209W, X130A-X209W, 130-X249N/R, X130A-249, X130A-X249N/R, 206-X209W, X206L/Y-209, X206L/Y-X209W, 206-X213A, X206L/Y-213, X206L/Y-X213A, X206L/Y-249, X206L/Y-X249N/R, X209W-213, X209W-X213A, X209W-249, X209W-X249N/R, 18-24-78, X18K/R-24-78, 18-X24F/P/R-78, 18-24-X78N, X18K/R-24-X78N, 18-X24F/P/R-X78N, X18K/R-X24F/P/R-78, X18K/R-X24F/P/R-X78N, 18-24-87, X18K/R-24-87, 18-X24F/P/R-87, 18-24-X87D/R, X18K/R-24-X87D/R, 18-X24F/P/R-X87D/R, X18K/R-X24F/P/R-87, X18K/R-X24F/P/R-X87D/R, 18-24-129, X18K/R-24-129, 18-X24F/P/R-129, 18-24-X129Q, X18K/R-X24F/P/R-129, X18K/R-24-X129Q, 18-X24F/P/R-X129Q, X18K/R-X24F/P/R-X129Q, 18-24-130, 18-X24F/P/R-130, 18-24-X130A, X18K/R-24-130, X18K/R-X24F/P/R-130, X18K/R-24-X130A, 18-X24F/P/R-X130A, X18K/R-X24F/P/R-X130A, 18-24-206, 18-24-X206L/Y, 18-X24F/P/R-206, X18K/R-24-206, X18K/R-24-X206L/Y, 18-X24F/P/R-X206L/Y, X18K/R-X24F/P/R-206, X18K/R-X24F/P/R-X206L/Y, 18-24-209, 18-24-X209W, 18-X24F/P/R-209, X18K/R-24-209, X18K/R-24-X209W, 18-X24F/P/R-X209W, X18K/R-X24F/P/R-209, X18K/R-X24F/P/R-X209W, 18-78-87, 18-X78N-87, 18-78-X87D/R, X18K/R-78-87, X18K/R-X78N-87, 18-X78N-X87D/R, X18K/R-78-X87D/R, X18K/R-X78N-X87D/R, 18-78-129, 18-X78N-129, 18-78-X129Q, X18K/R-78-129, X18K/R-X78N-129, X18K/R-78-X129Q, 18-X78N-X129Q, X18K/R-X78N-X129Q, 18-78-130, 18-X78N-130, 18-78-X130A, X18K/R-78-130, X18K/R-X78N-130, X18K/R-78-X130A, 18-X78N-X130A, X18K/R-X78N-X130A, 18-78-206, 18-78-X206L/Y, 18-X78N-206, X18K/R-78-206, 18-X78N-X206L/Y, X18K/R-X78N-206, X18K/R-78-X206L/Y, X18K/R-X78N-X206L/Y, 18-78-209, 18-X78N-209, 18-78-X209W, X18K/R-78-209, X18K/R-78-X209W, 18-X78N-X209W, X18K/R-X78N-209, X18K/R-X78N-X209W, 18-78-213, 18-X78N-213, 18-78-X213A, X18K/R-78-213, 18-X78N-X213A, X18K/R-X78N-213, X18K/R-78-X213A, X18K/R-X78N-X213A, 18-78-249, 18-78-X249N/R, 18-X78N-249, X18K/R-78-249, 18-X78N-X249N/R, X18K/R-X78N-249, X18K/R-78-X249N/R, X18K/R-X78N-X249N/R, 18-87-129, X18K/R-87-129, 18-X87D/R-129, 18-87-X129Q, 18-X87D/R-X129Q, X18K/R-87-X129Q, X18K/R-X87D/R-129, X18K/R-X87D/R-X129Q, 18-87-130, X18K/R-87-130, 18-X87D/R-130, 18-87-X130A, 18-X87D/R-X130A, X18K/R-87-X130A, X18K/R-X87D/R-130, X18K/R-X87D/R-X130A, 18-87-206, X18K/R-87-206, 18-X87D/R-206, 18-87-X206L/Y, 18-X87D/R-X206L/Y, X18K/R-87-X206L/Y, X18K/R-X87D/R-206, X18K/R-X87D/R-X206L/Y, 18-87-209, X18K/R-87-209, 18-X87D/R-209, 18-87-X209W, 18-X87D/R-X209W, X18K/R-X87D/R-209, X18K/R-87-X209W, X18K/R-X87D/R-X209W, 18-X87D/R-213, 18-87-X213A, 18-X87D/R-X213A, X18K/R-X87D/R-213, X18K/R-87-X213A, X18K/R-X87D/R-X213A, 18-87-249, X18K/R-87-249, 18-X87D/R-249, 18-87-X249N/R, 18-X87D/R-X249N/R, 18K/R-X87D/R-249, 18K/R-87-X249N/R, 18K/R-X87D/R-X249N/R, 18-129-130, X18K/R-129-130, 18-X129Q-130, 18-129-X130A, X18K/R-X129Q-130, X18K/R-129-X130A, 18-X129Q-X130A, X18K/R-X129Q-X130A, 18-129-206, X18K/R-129-206, 18-X129Q-206, 18-129-X206L/Y, X18K/R-X129Q-206, X18K/R-129-X206L/Y, 18-X129Q-X206L/Y, X18K/R-X129Q-X206L/Y, 18-129-209, X18K/R-129-209, 18-X129Q-209, 18-129-X209W, X18K/R-X129Q-209, X18K/R-129-X209W, 18-X129Q-X209W, X18K/R-X129Q-X209W, 18-129-213, X18K/R-129-213, 18-X129Q-213, 18-129-X213A, X18K/R-X129Q-213, X18K/R-129-X213A, 18-X129Q-X213A, X18K/R-X129Q-X213A, 18-129-249, X18K/R-129-249, 18-X129Q-249, 18-129-X249N/R, X18K/R-X129Q-249, X18K/R-129-X249N/R, 18-X129Q-X249N/R, X18K/R-X129Q-X249N/R, 18-130-206, X18K/R-130-206, 18-X130A-206, 18-130-

X206L/Y, X18K/R-X130A-206, X18K/R-130-X206L/Y, 18-X130A-X206L/Y, X18K/R-X130A-X206L/Y, 18-130-209, X18K/R-130-209, 18-X130A-209, 18-130-X209W, X18K/R-X130A-209, X18K/R-130-X209W, 18-X130A-X209W, X18K/R-X130A-X209W, 18-130-213, X18K/R-130-213, 18-X130A-213, 18-130-X213A, X18K/R-X130A-213, X18K/R-130-X213A, 18-X130A-X213A, X18K/R-X130A-X213A, 18-130-249, X18K/R-130-249, 18-X130A-249, 18-130-X249N/R, X18K/R-X130A-249, X18K/R-130-X249N/R, 18-X130A-X249N/R, X18K/R-X130A-X249N/R, 18-206-209, 18-206-X209W, 18-X206L/Y-209, 18K/R-206-209, 18-X206L/Y-X209W, X18K/R-X206L/Y-209, X18K/R-206-X209W, X18K/R-X206L/Y-X209W, 18-206-213, X18K/R-206-213, 18-206L/Y-213, 18-206-X213A, X18K/R-X206L/Y-213, X18K/R-206-X213A, 18-X206L/Y-X213A, X18K/R-X206L/Y-X213A, 18-206-249, X18K/R-206-249, 18-206L/Y-249, 18-206-X249N/R, X18K/R-X206L/Y-249, X18K/R-206-X249N/R, 18-X206L/Y-X249N/R, X18K/R-X206L/Y-X249N/R, 18-209-213, 18-X209W-213, X18K/R-209-213, 18-209-X213A, 18-X209W-X213A, X18K/R-X209W-213, X18K/R-209-X213A, X18K/R-X209W-X213A, 18-209-249, 18-X209W-249, X18K/R-209-249, 18-209-X249N/R, 18-X209W-X249N/R, 18K/R-X209W-249, X18K/R-209-X249N/R, X18K/R-X209W-X249N/R, 18-213-X249N/R, X18K/R-X213A-249, X18K/R-213-X249N/R, 18-X213A-X249N/R, X18K/R-X213A-X249N/R, 24-78-87, 24-78-X87D/R, 24-X78N-87, X24F/P/R-78-87, 24-X78N-X87D/R, X24R/P/F-78-X87D/R, X24F/P/R-X78N-87, X24R/P/F-X78N-X87D/R, 24-78-129, X24F/P/R-78-129, 24-X78N-129, 24-78-X129Q, X24F/P/R-X78N-129, X24F/P/R-78-X129Q, 24-X78N-X129Q, X24F/P/R-X78N-X129Q, 24-78-130, X24F/P/R-78-130, 24-X78N-130, 24-78-X130A, X24F/P/R-X78N-130 X24F/P/R-78-X130A, 24-X78N-X130A, X24F/P/R-X78N-X130A, 24-78-X206L/Y, X24F/P/R-78-206, 24-X78N-X206L/Y, X24F/P/R-X78N-206, X24F/P/R-78-X206L/Y, X24F/P/R-X78N-X206L/Y, 24-78-209, X24F/P/R-78-209, 24-X78N-209, 24-78-X209W, X24F/P/R-X78N-209, X24F/P/R-78-X209W, 24-X78N-X209W, X24F/P/R-X78N-X209W, 24-78-213, X24F/P/R-78-213, 24-X78N-213, 24-78-X213A, X24F/P/R-X78N-213, X24F/P/R-78-X213A, 24-X78N-X213A, X24F/P/R-X78N-X213A, 24-78-X249N/R, 24-X78N-249, 24-X78N-X249N/R, X24F/P/R-78-249, X24F/P/R-78-X249N/R, X24F/P/R-X78N-X249N/R, 24-87-129, X24F/P/R-87-129, 24-X87D/R-129, 24-87-X129Q, X24F/P/R-X87D/R-129, X24F/P/R-87-X129Q, 24-X87D/R-X129Q, X24F/P/R-X87D/R-X129Q, 24-87-130, X24F/P/R-87-130, 24-X87D/R-130, 24-87-X130A, X24F/P/R-X87D/R-130, X24F/P/R-87-X130A, 24-X87D/R-X130A, X24F/P/R-X87D/R-X130A, 24-87-X206L/Y, 24-X87R-206, X24F/P/R-87-206, 24-X87D/R-X206L/Y, X24F/P/R-X87D/R-206, X24F/P/R-87-X206L/Y, X24F/P/R-X87D/R-X206L/Y, 24-87-X209W, X24F/P/R-87-X209W, 24-87-X209W, 24-87D/R-X209W, X24F/P/R-X87D/R-X209W, 24-X87D/R-213, 24-87-X213A, X24F/P/R-X87D/R-X213A, X24F/P/R-87-X213A, X24F/P/R-87-X213A, X24F/P/R-X87D/R-X213A, 24-87-249, X24F/P/R-87-249, 24-X87D/R-249, 24-87-X249N/R, X24F/P/R-X87D/R-249, X24F/P/R-87-X249N/R, 24-X87D/R-X249N/R, X24F/P/R-X87D/R-X249N/R, 24-129-130, X24F/P/R-129-130, 24-X129Q-130, 24-129-X130A, X24F/P/R-X129Q-130, X24F/P/R-129-X130A, 24-X129Q-X130A, X24F/P/R-X129Q-X130A, 24-129-206, X24F/P/R-129-206, 24-X129Q-206, 24-129-X206L/Y, X24F/P/R-X129Q-206, X24F/P/R-129-X206L/Y, 24-X129Q-X206L/Y, X24F/P/R-X129Q-X206L/Y, 24-129-209, X24F/P/R-129-209, 24-X129Q-209, 24-129-X209W, X24F/P/R-X129Q-209, X24F/P/R-129-X209W, 24-X129Q-X209W, X24F/P/R-X129Q-X209W, 24-129-213, X24F/P/R-129-213, 24-X129Q-213, 24-129-X213A, X24F/P/R-X129Q-213, X24F/P/R-129-X213A, 24-X129Q-X213A, X24F/P/R-X129Q-X213A, 24-129-249, X24F/P/R-129-249, 24-X129Q-249, 24-129-X249N/R, X24F/P/R-X129Q-249, X24F/P/R-129-X249N/R, 24-X129Q-X249N/R, X24F/P/R-X129Q-X249N/R, 24-130-206, X24F/P/R-130-206, 24-X130A-206, 24-130-X206L/Y, X24F/P/R-X130A-206, X24F/P/R-130-X206L/Y, 24-X130A-X206L/Y, X24F/P/R-X130A-X206L/Y, 24-130-209, X24F/P/R-130-209, 24-X130A-209, 24-130-X209W, X24F/P/R-X130A-209, X24F/P/R-130-X209W, 24-X130A-X209W, X24F/P/R-X130A-X209W, 24-130-213, X24F/P/R-130-213, 24-X130A-213, 24-130-X213A, X24F/P/R-X130A-213, X24F/P/R-130-X213A, 24-X130A-X213A, X24F/P/R-X130A-X213A, 24-130-249, X24F/P/R-130-249, 24-X130A-249, 24-130-X249N/R, X24F/P/R-X130A-249, X24F/P/R-130-X249N/R, 24-X130A-X249N/R, X24F/P/R-X130A-X249N/R, 24-206-209, 24-206-X209W, 24-X206L/Y-209, 24F/P/R-206-209, 24-X206L/Y-X209W, X24F/P/R-X206L/Y-209, X24F/P/R-206-X209W, X24F/P/R-X206L/Y-X209W, 24-206-213, X24F/P/R-206-213, 24-X206L/Y-213, 24-206-X213A, X24F/P/R-X206L/Y-213, X24F/P/R-206-X213A, 24-X206L/Y-X213A, X24F/P/R-X206L/Y-X213A, 24-206-249, X24-X206L/Y-249, X24F/P/R-206-249, 24-206-X249N/R, 24-X206L/Y-X249N/R, X24F/P/R-X206L/Y-249, X24F/P/R-206-X249N/R, X24F/P/R-X206L/Y-X249N/R, 24-209-213, 24-X209W-213, X24F/P/R-209-213, 24-209-X213A, X24F/P/R-X209W-213, 24-X209W-X213A, X24F/P/R-209-X213A, X24F/P/R-X209W-X213A, 24-209-249, 24-X209W-249, X24F/P/R-209-249, 24-209-X249N/R, X24F/P/R-X209W-249, 24-X209W-X249N/R, X24F/P/R-209-X249N/R, X24F/P/R-X209W-X249N/R, 78-87-129, X78N-87-129, 78-X87D/R-129, 78-87-X129Q, X78N-X87D/R-129, X78N-87-X129Q, 78-X87D/R-X129Q, X78N-X87D/R-X129Q, 78-87-130, X78N-87-130, 78-X87D/R-130, 78-87-X130A, X78N-X87D/R-130, X78N-87-X130A, 78-X87D/R-X130A, X78N-X87D/R-X130A, 78-87-206, 78-87-X206L/Y, X78N-87-206, 78-X87D/R-206, 78-X87D/R-X206L/Y, X78N-X87D/R-206, X78N-X87D/R-X206L/Y, 78-87-209, 78-87-X209W, X78N-87-209, 78-X87D/R-209, X78N-X87D/R-209, 78-X87D/R-X209W, X78N-87-X209W, X78N-X87D/R-X209W, 78-87-213, X78N-87-213, 78-X87D/R-213, 78-87-X213A, X78N-X87D/R-213, X78N-87-X213A, 78-X87D/R-X213A, X78N-X87D/R-X213A, 78-87-249, 78-87-X249N/R, X78N-87-249, 78-87D/R-249, X78N-X87D/R-249, 78-X87D/R-X249N/R, X78N-87-X249N/R, X78N-X87D/R-X249N/R, 78-129-130, X78N-129-130, 78-X129Q-130, 78-129-X130A, X78N-X129Q-130, X78N-129-X130A, 78-X129Q-X130A, X78N-X129Q-X130A, 78-129-206, X78N-129-206, 78-X129Q-206, 78-129-X206L/Y, X78N-X129Q-206, X78N-129-X206L/Y, 78-X129Q-X206L/Y, X78N-X129Q-X206L/Y, 78-129-209, X78N-129-209, 78-X129Q-209, 78-129-X209W, X78N-X129Q-209, X78N-129-X209W, 78-X129Q-X209W, X78N-X129Q-X209W, 78-129-213, X78N-129-213, 78-X129Q-213, 78-129-X213A, X78N-X129Q-213, X78N-129-X213A, 78-X129Q-X213A, X78N-X129Q-X213A, 78-129-249, X78N-129-249, 78-X129Q-249, 78-129-X249N/R, X78N-X129Q-249, X78N-129-X249N/R, 78-X129Q-X249N/R, X78N-X129Q-X249N/R, 78-130-206, X78N-130-206, 78-X130A-206, 78-130-X206L/Y, X78N-X130A-206, X78N-130-X206L/Y, 78-X130A-X206L/Y, X78N-X130A-

X206L/Y, 78-130-209, X78N-130-209, 78-X130A-209, 78-130-X209W, X78N-X130A-209, X78N-130-X209W, 78-X130A-X209W, X78N-X130A-X209W, 78-130-213, X78N-130-213, 78-X130A-213, 78-130-X213A, X78N-X130A-213, X78N-130-X213A, 78-X130A-X213A, X78N-X130A-X213A, 78-130-213, X78N-130-213, 78-X130A-213, 78-130-X213A, X78N-X130A-213, X78N-130-X213A, 78-X130A-X213A, X78N-X130A-X213A, 78-130-249, X78N-130-249, 78-X130A-249, 78-130-X249N/R, X78N-X130A-249, X78N-130-X249N/R, 78-X130A-X249N/R, X78N-X130A-X249N/R, 78-206-209, X78N-206-209, 78-X206L/Y-209, 78-206-X209W, X78N-X206L/Y-209, X78N-206-X209W, 78-X206L/Y-X209W, X78N-X206L/Y-X209W, 78-206-213, X78N-206-213, 78-X206L/Y-213, 78-206-X213A, X78N-X206L/Y-213, X78N-206-X213A, 78-X206L/Y-X213A, X78N-X206L/Y-X213A, 78-206-249, 78-206-X249R/N, 78-X206L/Y-249, X78N-206-249, X78N-206-X249N/R, 78-X206L/Y-X249N/R, X78N-X206L/Y-249, X78N-X206L/Y-X249N/R, 78-209-213, 78-X209W-213, 78-209-X213A, X78N-209-213, X78N-X209W-213, X78N-209-X213A, 78-X209W-X213A, X78N-X209W-X213A, 78-209-249, 78-X209W-249, 78-209-X249N/R, X78N-209-249, 78-X209W-X249N/R, X78N-X209W-249, X78N-209-X249N/R, X78N-X209W-X249N/R, 78-213-249, 78-X213A-249, X78N-213-249, 78-213-X249N/R, X78N-X213A-249, X78N-213-X249N/R, 78-X213A-X249N/R, X78N-X213A-X249N/R, 87-129-130, 87-X129Q-130, 87-129-X130A, X87D/R-129-130, X87D/R-129-X130A, 87-X129Q-X130A, X87D/R-X129Q-X130A, 87-129-206, X87D/R-129-206, 87-X129Q-206, 87-129-X206L/Y, X87D/R-X129Q-206, X87D/R-129-X206L/Y, 87-X129Q-X206L/Y, X87D/R-X129Q-X206L/Y, 87-129-209, X87D/R-129-209, 87-X129Q-209, 87-129-X209W, X87D/R-X129Q-209, X87D/R-129-X209W, 87-X129Q-X209W, X87D/R-X129Q-X209W, 87-129-213, X87D/R-129-213, 87-X129Q-213, 87-129-X213A, X87D/R-X129Q-213, X87D/R-129-X213A, 87-X129Q-X213A, X87D/R-X129Q-X213A, 87-129-249, X87D/R-129-249, 87-X129Q-249, 87-129-X249N/R, X87D/R-X129Q-249, X87D/R-129-X249N/R, 87-X129Q-X249N/R, X87D/R-X129Q-X249N/R, 87-130-206, X87D/R-130-206, 87-X130A-206, 87-130-X206L/Y, X87D/R-X130A-206, X87D/R-130-X206L/Y, 87-X130A-X206L/Y, X87D/R-X130A-X206L/Y, 87-130-209, X87D/R-130-209, 87-X130A-209, 87-130-X209W, X87D/R-X130A-209, X87D/R-130-X209W, 87-X130A-X209W, X87D/R-X130A-X209W, 87-130-213, X87D/R-130-213, 87-X130A-213, 87-130-X213A, X87D/R-X130A-213, X87D/R-130-X213A, 87-X130A-X213A, X87D/R-X130A-X213A, 87-130-249, X87D/R-130-249, 87-X130A-249, 87-130-X249N/R, X87D/R-X130A-249, X87D/R-130-X249N/R, 87-X130A-X249N/R, X87D/R-X130A-X249N/R, 87-206-209, X87D/R-206-209, 87-X206L/Y-209, 87-206-X209W, X87D/R-X206L/Y-209, X87D/R-206-X209W, 87-X206L/Y-X209W, X87D/R-X206L/Y-X209W, 87-206-213, 87-X206L/Y-213, 87-206-X213A, X87D/R-206-213, X87D/R-X206L/Y-213, X87D/R-206-X213A, 87-X206L/Y-X213A, X87D/R-X206L/Y-X213A, 87-206-249, 87-X206L/Y-249, X87D/R-206-249, 87-209-X249N/R, X87R-206-X249N/R, X87D/R-X206L/Y-249, 87-X206L/Y-X249N/R, X87R-X206L/Y-X249N/R, 87-209-213, X87D/R-209-213, 87-X209W-213, 87-209-X213A, X87D/R-X209W-213, X87D/R-209-X213A, 87-X209W-X213A, X87D/R-X209W-X213A, 87-209-249, 87-X209W-249, 87-209-X249N/R, X87D/R-209-249, X87D/R-X209W-249, 87-X209W-X249N/R, X87R-209-X249N/R, X87D/R-X209W-X249N/R, 87-213-249, 87-X213A-249, X87D/R-213-249, 87-213-X249N/R, X87D/R-X213A-249, X87D/R-213-X249N/R, 87-X213A-X249N/R, X87D/R-X213A-X249N/R, 129-130-206, X129Q-130-206, 129-X130A-206, 129-130-X206L/Y, X129Q-X130A-206, X129Q-130-X206L/Y, 129-X130A-X206L/Y, X129Q-X130A-X206L/Y, 129-130-209, X129Q-130-209, 129-X130A-209, 129-130-X209W, X129Q-X130A-209, X129Q-130-X209W, 129-X130A-X209W, X129Q-X130A-X209W, 129-130-213, X129Q-130-213, 129-X130A-213, 129-130-X213A, X129Q-X130A-213, X129Q-130-X213A, 129-X130A-X213A, X129Q-X130A-X213A, 129-130-249, X129Q-130-249, 129-X130A-249, 129-130-X249N/R, X129Q-X130A-249, X129Q-130-X249N/R, 129-X130A-X249N/R, X129Q-X130A-X249N/R, 129-206-209, X129Q-206-209, 129-X206L/Y-209, 129-206-X209W, X129Q-X206L/Y-209, X129Q-206-X209W, 129-X206L/Y-X209W, X129Q-X206L/Y-X209W, 129-206-213, 129-X206L/Y-213, 129-206-X213A, X129Q-206-213, X129Q-X206L/Y-213, X129Q-206-X213A, 129-X206L/Y-X213A, X129Q-X206L/Y-X213A, 129-206-249, 129-X206L/Y-249, 129-206-X249N/R, X129Q-206-249, X129A-X206L/Y-249, X129Q-206-X249N/R, 129-X206L/Y-X249N/R, X129Q-X206L/Y-X249N/R, 129-209-213, 129-X209W-213, 129-209-X213A, X129Q-209-213, X129Q-X209W-213, X129Q-209-X213A, 129-X209W-X213A, X129Q-X209W-X213A, 129-209-249, 129-X209W-249, 129-209-X249N/R, X129Q-209-249, X129Q-X209W-249, X129Q-209-X249N/R, 129-X209W-X249N/R, X129Q-X209W-X249N/R, 129-213-249, 129-X213A-249, 129-213-X249N/R, X129Q-213-249, X129Q-X213A-249, 129-X213A-X249R, X129Q-213-X249N/R, X129Q-X213A-X249N/R, 130-206-209, X130A-206-209, 130-X206L/Y-209, 130-209-X209W, X130A-X206L/Y-209, X130A-206-X209W, 130-X206L/Y-X209W, X130A-X206L/Y-X209W, 130-206-213, 130-X206L/Y-213, 130-206-X213A, X130A-206-213, X130A-X206L/Y-213, X130A-206-X213A, 130-X206L/Y-X213A, X130A-X206L/Y-X213A, 130-206-249, 130-X206L/Y-249, 130-206-X249N/R, X130A-206-249, X130A-X206L/Y-249, X130A-206-X249N/R, 130-X206L/Y-X249N/R, X130A-X206L/Y-X249N/R, 130-209-213, 130-X209W-213, 130-209-X213A, X130A-209-213, X130A-X209W-213, X130A-209-X213A, 130-X209W-X213A, X130A-X209W-X213A, 130-209-249, 130-X209W-249, 130-209-X249N/R, X130A-209-249, X130A-X209W-249, X130A-209-X249N/R, 130-X209W-X249N/R, X130A-X209W-X249N/R, 130-213-249, 130-X213A-249, 130-213-X249N/R, X130A-213-249, X130A-X213A-249, 130-X213A-X249R, X130A-213-X249N/R, X130A-X213A-X249N/R, 130-209-249, 130-X209W-249, 130-209-X249N/R, X130A-209-249, X130A-X209W-249, X130A-209-X249N/R, 130-X209W-X249N/R, X130A-X209W-X249N/R, 206-209-213, 206-X209W-213, 206-209-X213A, X206L/Y-209-213, 206-X209W-X213A, X206L/Y-X209W-213, X206L/Y-209-X213A, X206L/Y-X209W-X213A, 206-209-249, 206-X209W-249, 206-209-X249N/R, X206L/Y-209-249, X206L/Y-X209W-249, X206L/Y-209-X249N/R, 206-X209W-X249N/R, X206L/Y-X209W-X249N/R, 206-213-249, 206-X213A-249, 206-213-X249N/R X206L/Y-213-249, X206L/Y-X213A-249, X206L/Y-213-X249N/R, 206-X213A-X249N/R, X206L/Y-X213A-X249N/R, 209-213-249, X209W-213-249, 209-X213A-249, 209-213-X249N/R, X209W-X213A-249, X209W-213-X249N/R, 209-X213A-X249N/R, X209W-X213A-X249N/R, and combinations thereof, wherein X is any amino acid, said variant has proteolytic activity, and the amino acid sequence of said variant further comprises one or more substitutions selected from: (i) 76, 101, 103, 104, 118, 127, 128, 166, and 222, (ii) X76D, X101F/G/V, X103A/D/P, X104I, X118R, X127T, X128L, X166D/N and X222Q/S, or (iii) N76D, S101F/G/V, S103A/D/P, V104I, G118R, G127T, S128L, S166D/N, and M222Q/S; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence.

Another embodiment provides an isolated subtilisin variant comprising a combination of amino acid substitutions at two or more positions selected from: S78N-Q206F/M/Y, S78G-Q206D/F/H/M/N/P/R/Y, N18K/R-S78N, N18K/R-S87R, N18K/R-Q206L/Y, S24F/L/P/R-S87R, S24F/L/P-Q206L/Y, S24F/L/P/R-Q206Y, S24F/L/P-Y209W, P40E-S78G, P40E-S87R, P40E-P129Q, P40E-S130A, S78N-S87D/R, S78G-S87D/R/T, S78A/C/E/F/H/I/K/L/M/P/Q/R/T/V/W/Y-S87R, S78A/C/E/F/G/H/I/K/L/M/P/Q/R/T/V/W/Y-P129Q, S78A/C/E/F/H/I/K/L/M/P/Q/R/T/V/W/Y-S130A, S78G-S130A/Q, S78N-H249N/R, S87D/R-Q206L/R/Y, S87D/R-Y209W, S87D/R-T213A, S87R-H249N/R, P129Q-Q206RY, P129Q-H249N/R, S130A-Q206R/Y, S130A-H249N/R, Q206Y-Y209W, Q206L/Y-T213A, Q206L/Y-H249N/R, Y209W-T213A, Y209W-H249N/R, N18K/R-S24F/L/P/R-S78N, N18K/R-S24F/L/P/R-S87D/R, N18K/R-S24F/L/P/R-P129Q, N18K/R-S24F/L/P/R-S130A, N18K/R-S24F/L/P/R-Q206L/Y, N18K/R-S24F/L/P/R-Y209W, N18K/R-S78N-S87D/R, N18K/R-S78N-P129Q, N18K/R-S78N-S130A, N18K/R-S78N-Q206L/Y, N18K/R-S78N-Y209W, N18K/R-S78N-T213A, N18K/R-S78N-H249N/R, N18K/R-S87D/R-P129Q, N18K/R-S87D/R-S130A, N18K/R-S87D/R-Q206L/Y, N18K/R-S87D/R-Y209W, N18K/R-S87D/R-T213A, N18K/R-S87D/R-H249, N18K/R-P129Q-S130A, N18K/R-P129Q-Q206L/Y, N18K/R-P129Q-209, N18K/R-P129Q-T213A, N18K/R-P129Q-H249N/R, N18K/R-S130A-Q206L/Y, N18K/R-S130A-Y209W, N18K/R-S130A-T213A, N18K/R-S130A-H249N/R, N18K/R-Q206L/Y-Y209W, N18K/R-Q206L/Y-T213A, N18K/R-Q206L/Y-H249N/R, N18K/R-Y209W-T213A, N18K/R-Y209W-H249N/R, N18K/R-T213A-H249N/R, S24F/L/P/R-S78N-S87D/R, S24F/L/P-S78N-P129Q, S24F/L/P-S78N-S130A, S24F/L/P-S78N-Q206L/Y, S24F/L/P/R-S78N-Q206Y, S24F/L/P-S78N-Y209W, S24F/L/P/R-S78N-T213A, S24F/L/P/R-S78N-H249N/R, S24F/L/P/R-S87D/R-P129Q, S24F/L/P/R-S87D/R-S130A, S24F/L/P/R-S87D/R-Q206L/Y, S24F/L/P/R-87D/R-Y209W, S24F/L/P/R-S87D/R-T213A, S24F/L/P/R-S87D/R-H249, S24F/L/P-P129Q-S130A, S24F/L/P-P129Q-Q206L/Y, S24F/L/P/R-P129Q-Q206Y, S24F/L/P-P129Q-Y209W, S24F/L/P/R-P129Q-T213A, S24F/L/P/R-P129Q-H249N/R, S24F/L/P-S130A-Q206L/Y, S24F/L/P/R-S130A-Q206Y, S24F/L/P-S130A-Y209W, S24F/L/P/R-S130A-T213A, S24F/L/P/R-S130A-H249N/R, S24F/L/P-Q206L/Y-Y209W, S24F/L/P/R-Q206Y-Y209W, S24F/L/P/R-Q206L/Y-T213A, S24F/L/P/R-Q206L/Y-H249N/R, S24F/L/P/R-Y209W-T213A, S24F/L/P/R-Y209W-H249N/R, S78N-S87D/R-P129Q, S78N-S87D/R-S130A, S78N-S87D/R-Q206L/Y, S78N-S87D/R-Y209W, S78N-S87D/R-T213A, S78N-S87D/R-H249N/R, S78N-P129Q-Q206Y, S78N-P129Q-T213A, S78N-P129Q-H249N/R, S78N-S130A-Q206Y, S78N-S130A-T213A, S78N-S130A-H249N/R, S78N-Q206L/Y-T213A, S78N-Q206L/Y-H249N/R, S78N-Y209W-T213A, S78N-Y209W-H249N/R, S78N-T213A-H249N/R, S87D/R-P129Q-S130A, S87D/R-P129Q-Q206L/R/Y, S87D/R-P129Q-Y209W, S87D/R-P129Q-T213A, S87D/R-P129Q-H249N/R, S87D/R-S130A-Q206L/R/Y, S87D/R-S130A-Y209W, S87D/R-S130A-T213A, S87D/R-S130A-H249N/R, S87D/R-Q206L/Y-Y209W, S87D/R-Q206L/Y-T213A, 87D/R-Q206L/Y-H249N/R, S87D/R-Y209W-T213A, S87D/R-Y209W-H249N/R, S87D/R-T213A-H249N/R, P129Q-S130A-Q206R/Y, P129Q-S130A-T213A, P129Q-S130A-H249N/R, P129Q-Q206Y-Y209W, P129Q-Q206L/Y-T213A, P129Q-Q206L/Y-H249N/R, P129Q-Y209W-T213A, P129Q-Y209W-H249N/R, P129Q-T213A-H249N/R, S130A-Q206Y-Y209W, S130A-Q206L/Y-T213A, S130A-Q206L/Y-H249N/R, S130A-Y209W-T213A, S130A-Y209W-H249N/R, S130A-T213A-H249N/R, S130A-Y209W-H249N/R, Q206L/Y-Y209W-T213A, Q206L/Y-Y209W-H249N/R, Q206L/Y-T213A-H249N/R, Y209W-T213A-H249N/R, and combinations thereof; and wherein said variant has proteolytic activity and each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. A still further embodiment provides an isolated subtilisin variant comprising a combination of amino acid substitutions at two or more positions selected from: S78N-Q206F/M/Y, S78G-Q206D/F/H/M/N/P/R/Y, N18K/R-S78N, N18K/R-S87R, N18K/R-Q206L/Y, S24F/L/P/R-S87R, S24F/L/P-Q206L/Y, S24F/L/P/R-Q206Y, S24F/L/P-Y209W, P40E-S78G, P40E-S87R, P40E-P129Q, P40E-S130A, S78N-S87D/R, S78G-S87D/R/T, S78A/C/E/F/H/I/K/L/M/P/Q/R/T/V/W/Y-S87R, S78A/C/E/F/G/H/I/K/L/M/P/Q/R/T/V/W/Y-P129Q, S78A/C/E/F/H/I/K/L/M/P/Q/R/T/V/W/Y-S130A, S78G-S130A/Q, S78N-H249N/R, S87D/R-Q206L/R/Y, S87D/R-Y209W, S87D/R-T213A, S87R-H249N/R, P129Q-Q206RY, P129Q-H249N/R, S130A-Q206R/Y, S130A-H249N/R, Q206Y-Y209W, Q206L/Y-T213A, Q206L/Y-H249N/R, Y209W-T213A, Y209W-H249N/R, N18K/R-S24F/L/P/R-S78N, N18K/R-S24F/L/P/R-S87D/R, N18K/R-S24F/L/P/R-P129Q, N18K/R-S24F/L/P/R-S130A, N18K/R-S24F/L/P/R-Q206L/Y, N18K/R-S24F/L/P/R-Y209W, N18K/R-S78N-S87D/R, N18K/R-S78N-P129Q, N18K/R-S78N-S130A, N18K/R-S78N-Q206L/Y, N18K/R-S78N-Y209W, N18K/R-S78N-T213A, N18K/R-S78N-H249N/R, N18K/R-S87D/R-P129Q, N18K/R-S87D/R-S130A, N18K/R-S87D/R-Q206L/Y, N18K/R-S87D/R-Y209W, N18K/R-S87D/R-T213A, N18K/R-S87D/R-H249, N18K/R-P129Q-S130A, N18K/R-P129Q-Q206L/Y, N18K/R-P129Q-209, N18K/R-P129Q-T213A, N18K/R-P129Q-H249N/R, N18K/R-S130A-Q206L/Y, N18K/R-S130A-Y209W, N18K/R-S130A-T213A, N18K/R-S130A-H249N/R, N18K/R-Q206L/Y-Y209W, N18K/R-Q206L/Y-T213A, N18K/R-Q206L/Y-H249N/R, N18K/R-Y209W-T213A, N18K/R-Y209W-H249N/R, N18K/R-T213A-H249N/R, S24F/L/P/R-S78N-S87D/R, S24F/L/P-S78N-P129Q, S24F/L/P-S78N-S130A, S24F/L/P-S78N-Q206L/Y, S24F/L/P/R-S78N-Q206Y, S24F/L/P-S78N-Y209W, S24F/L/P/R-S78N-T213A, S24F/L/P/R-S78N-H249N/R, S24F/L/P/R-S87D/R-P129Q, S24F/L/P/R-S87D/R-S130A, S24F/L/P/R-S87D/R-Q206L/Y, S24F/L/P/R-87D/R-Y209W, S24F/L/P/R-S87D/R-T213A, S24F/L/P/R-S87D/R-H249, S24F/L/P-P129Q-S130A, S24F/L/P-P129Q-Q206L/Y, S24F/L/P/R-P129Q-Q206Y, S24F/L/P-P129Q-Y209W, S24F/L/P/R-P129Q-T213A, S24F/L/P/R-P129Q-H249N/R, S24F/L/P-S130A-Q206L/Y, S24F/L/P/R-S130A-Q206Y, S24F/L/P-S130A-Y209W, S24F/L/P/R-S130A-T213A, S24F/L/P/R-S130A-H249N/R, S24F/L/P-Q206L/Y-Y209W, S24F/L/P/R-Q206Y-Y209W, S24F/L/P/R-Q206L/Y-T213A, S24F/L/P/R-Q206L/Y-H249N/R, S24F/L/P/R-Y209W-T213A, S24F/L/P/R-Y209W-H249N/R, S78N-S87D/R-P129Q, S78N-S87D/R-S130A, S78N-S87D/R-Q206L/Y, S78N-S87D/R-Y209W, S78N-S87D/R-T213A, S78N-S87D/R-H249N/R, S78N-P129Q-Q206Y, S78N-P129Q-T213A, S78N-P129Q-H249N/R, S78N-S130A-Q206Y, S78N-S130A-T213A, S78N-S130A-H249N/R, S78N-Q206L/Y-T213A, S78N-Q206L/Y-H249N/R, S78N-Y209W-T213A, S78N-Y209W-H249N/R, S78N-T213A-H249N/R, S87D/R-P129Q-S130A, S87D/R-P129Q-Q206L/R/Y, S87D/R-P129Q-Y209W, S87D/R-P129Q-T213A, S87D/R-P129Q-H249N/R, S87D/R-S130A-Q206L/R/Y, S87D/R-S130A-Y209W, S87D/R-S130A-T213A, S87D/R-S130A-H249N/R, S87D/R-Q206L/Y-Y209W, S87D/R-Q206L/Y-T213A, 87D/R-Q206L/Y-H249N/R, S87D/R-Y209W-T213A, S87D/R-Y209W-H249N/R, S87D/R-T213A-H249N/R, P129Q-S130A-Q206R/Y, P129Q-S130A-T213A, P129Q-S130A-H249N/R, P129Q-Q206Y-Y209W, P129Q-Q206L/Y-T213A, P129Q-Q206L/Y-H249N/R, P129Q-Y209W-T213A, P129Q-Y209W-H249N/R, P129Q-T213A-H249N/R, S130A-Q206Y-Y209W, S130A-Q206L/Y-T213A, S130A-Q206L/Y-H249N/R, S130A-Y209W-T213A, S130A-Y209W-H249N/R, S130A-T213A-H249N/R, S130A-Y209W-H249N/R, Q206L/Y-Y209W-T213A, Q206L/Y-Y209W-H249N/R, Q206L/Y-T213A-H249N/R, Y209W-T213A-H249N/R, and combinations thereof, wherein said variant has proteolytic activity and the amino acid sequence of said variant further comprises one or more substitutions selected from: (i) 1, 3, 8, 9, 16, 20, 22, 28, 42, 43, 44, 56, 76, 77, 82, 88, 89, 99, 100, 101, 103, 104, 108, 116, 118, 120, 124, 127, 128, 147, 150, 158, 159, 160, 166, 185, 188, 194, 204, 210, 211, 212, 215, 216, 217, 218, 222, 232, 235, 241, 243, 245, 246, 248, 251, 252, 254, 256, 259, 261, 262, 268, 270, and 271; (ii) X1V, X3I/T/V, X8V, X9G, X16T, X20E/R, X22L/W, X28T, X42I, X43R/S/Y, X44V, X56P, X76D, X77D, X82D, X88S, X89H, X99N, X100S, X101F/G/H/Q/T/V, X103A/D/P, X104I, X108S, X116L/M, X118A/R/V, X120R, X124M, X127S/T, X128K/L/R, X147I, X150T, X158E/T/V, X159D, X160Q, X166D/N, X185Y, X188D, X194D/P, X204D, X210I/L, X211P, X212D, X215K/V, X216Y, X217K, X218S, X222L/Q/S, X232V, X235T, X241K, X243S, X245R, X246V, X248D, X251R, X252I, X254T, X256P, X259G, X261I/N, X262Q, X268A, X270P/T, and X271D; or (iii) A1V, S3I/T/V, 18V, S9G, A16T, G20E/R, T22L/W, V28T, L42I, N43R/S/Y, I44V, S56P, N76D, N77D, L82D, A88S, E89H, S99N, G100S, S101F/G/H/Q/T/V, S103A/D/P, V104I, A108S, NI16L/M, GI18A/R/V, H120R, L124M, G127S/T, S128K/LR, V147I, V150T, A158E/T/V, G159D, S160Q, S166D/N, N185Y, S188D, A194D/P, N204D, P210I/L, G211P, S212D, A215K/V, S216Y, L217K, N218S, M222L/Q/S, A232V, K235T, W241K, N243S, Q245R, I246V, N248D, K251R, N252I, A254T, S256P, S259G, N261I/N, L262Q, V268A, A270P/T, and E271D; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. An even still further embodiment provides an isolated subtilisin variant comprising a combination of amino acid substitutions at two or more positions selected from: S78N-Q206F/M/Y, S78G-Q206D/F/H/M/N/P/R/Y, N18K/R-S78N, N18K/R-S87R, N18K/R-Q206L/Y, S24F/L/P/R-S87R, S24F/L/P-Q206L/Y, S24F/L/P/R-Q206Y, S24F/L/P-Y209W, P40E-S78G, P40E-S87R, P40E-P129Q, P40E-S130A, S78N-S87D/R, S78G-S87D/R/T, S78A/C/E/F/H/I/K/L/M/P/Q/R/T/V/W/Y-S87R, S78A/C/E/F/G/H/I/K/L/M/P/Q/R/T/V/W/Y-P129Q, S78A/C/E/F/H/I/K/L/M/P/Q/R/T/V/W/Y-S130A, S78G-S130A/Q, S78N-H249N/R, S87D/R-Q206L/R/Y, S87D/R-Y209W, S87D/R-T213A, S87R-H249N/R, P129Q-Q206RY, P129Q-H249N/R, S130A-Q206R/Y, S130A-H249N/R, Q206Y-Y209W, Q206L/Y-T213A, Q206L/Y-H249N/R, Y209W-T213A, Y209W-H249N/R, N18K/R-S24F/L/P/R-S78N, N18K/R-S24F/L/P/R-S87D/R, N18K/R-S24F/L/P/R-P129Q, N18K/R-S24F/L/P/R-S130A, N18K/R-S24F/L/P/R-Q206L/Y, N18K/R-S24F/L/P/R-Y209W, N18K/R-S78N-S87D/R, N18K/R-S78N-P129Q, N18K/R-S78N-S130A, N18K/R-S78N-Q206L/Y, N18K/R-S78N-Y209W, N18K/R-S78N-T213A, N18K/R-S78N-H249N/R, N18K/R-S87D/R-P129Q, N18K/R-S87D/R-S130A, N18K/R-S87D/R-Q206L/Y, N18K/R-S87D/R-Y209W, N18K/R-S87D/R-T213A, N18K/R-S87D/R-H249, N18K/R-P129Q-S130A, N18K/R-P129Q-Q206L/Y, N18K/R-P129Q-209, N18K/R-P129Q-T213A, N18K/R-P129Q-H249N/R, N18K/R-S130A-Q206L/Y, N18K/R-S130A-Y209W, N18K/R-S130A-T213A, N18K/R-S130A-H249N/R, N18K/R-Q206L/Y-Y209W, N18K/R-Q206L/Y-T213A, N18K/R-Q206L/Y-H249N/R, N18K/R-Y209W-T213A, N18K/R-Y209W-H249N/R, N18K/R-T213A-H249N/R, S24F/L/P/R-S78N-S87D/R, S24F/L/P-S78N-P129Q, S24F/L/P-S78N-S130A, S24F/L/P-S78N-Q206L/Y, S24F/L/P/R-S78N-Q206Y, S24F/L/P-S78N-Y209W, S24F/L/P/R-S78N-T213A, S24F/L/P/R-S78N-H249N/R, S24F/L/P/R-S87D/R-P129Q, S24F/L/P/R-S87D/R-S130A, S24F/L/P/R-S87D/R-Q206L/Y, S24F/L/P/R-87D/R-Y209W, S24F/L/P/R-S87D/R-T213A, S24F/L/P/R-S87D/R-H249, S24F/L/P-P129Q-S130A, S24F/L/P-P129Q-Q206L/Y, S24F/L/P/R-P129Q-Q206Y, S24F/L/P-P129Q-Y209W, S24F/L/P/R-P129Q-T213A, S24F/L/P/R-P129Q-H249N/R, S24F/L/P-S130A-Q206L/Y, S24F/L/P/R-S130A-Q206Y, S24F/L/P-S130A-Y209W, S24F/L/P/R-S130A-T213A, S24F/L/P/R-S130A-H249N/R, S24F/L/P-Q206L/Y-Y209W, S24F/L/P/R-Q206Y-Y209W, S24F/L/P/R-Q206L/Y-T213A, S24F/L/P/R-Q206L/Y-H249N/R, S24F/L/P/R-Y209W-T213A, S24F/L/P/R-Y209W-H249N/R, S78N-S87D/R-P129Q, S78N-S87D/R-S130A, S78N-S87D/R-Q206L/Y, S78N-S87D/R-Y209W, S78N-S87D/R-T213A, S78N-S87D/R-H249N/R, S78N-P129Q-Q206Y, S78N-P129Q-T213A, S78N-P129Q-H249N/R, S78N-S130A-Q206Y, S78N-S130A-T213A, S78N-S130A-H249N/R, S78N-Q206L/Y-T213A, S78N-Q206L/Y-H249N/R, S78N-Y209W-T213A, S78N-Y209W-H249N/R, S78N-T213A-H249N/R, S87D/R-P129Q-S130A, S87D/R-P129Q-Q206L/R/Y, S87D/R-P129Q-Y209W, S87D/R-P129Q-T213A, S87D/R-P129Q-H249N/R, S87D/R-S130A-Q206L/R/Y, S87D/R-S130A-Y209W, S87D/R-S130A-T213A, S87D/R-S130A-H249N/R, S87D/R-Q206L/Y-Y209W, S87D/R-Q206L/Y-T213A, 87D/R-Q206L/Y-H249N/R, S87D/R-Y209W-T213A, S87D/R-Y209W-H249N/R, S87D/R-T213A-H249N/R, P129Q-S130A-Q206R/Y, P129Q-S130A-T213A, P129Q-S130A-H249N/R, P129Q-Q206Y-Y209W, P129Q-Q206L/Y-T213A, P129Q-Q206L/Y-H249N/R, P129Q-Y209W-T213A, P129Q-Y209W-H249N/R, P129Q-T213A-H249N/R, S130A-Q206Y-Y209W, S130A-Q206L/Y-T213A, S130A-Q206L/Y-H249N/R, S130A-Y209W-T213A, S130A-Y209W-H249N/R, S130A-T213A-H249N/R, S130A-Y209W-H249N/R, Q206L/Y-Y209W-T213A, Q206L/Y-Y209W-H249N/R, Q206L/Y-T213A-H249N/R, Y209W-T213A-H249N/R, and combinations thereof, wherein said variant has proteolytic activity and the amino acid sequence of said variant further comprises one or more substitutions selected from: (i) 3, 8, 22, 28, 43, 76, 89, 99, 101, 103, 104, 108, 116, 118, 124, 127, 128, 147, 150, 158, 159, 166, 188, 194, 210, 211, 212, 215, 217, 222, 232, 235, 243, 245, 246, 261, 262, 270, and 271; (ii) X3T/V, X8V, X22W, X28T, X43S, X76D, X89H, X99N, X101F/G/V, X103A/D/P, X104I, X108S, X116M, X118R, X124M, X127T, X128L, X147I, X150T, X158E/T, X159D, X166D, X188D, X194D/P, X210I/L, X211P, X212D, X215V, X217K, X222Q/S, X232V, X235T, X243S, X245R, X246V, X261I, X262Q, X270T, and X271D; or (iii) S3T/V, I8V, T22W, V28T, N43S, N76D, E89H, S99N, S101F/G/V, S103A/D/P, V104I, A108S, N116M, G118R, L124M, G127T, S128L, V147I, V150T, A158E/T, G159D, S166D, S188D, A194D/P, P210I/L, G211P, S212D, A215V, L217K, M222Q/S, A232V, K235T, N243S, Q245R, I246V, N261I, L262Q, A270T, and E271D; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. A still further embodiment provides an isolated subtilisin variant comprising a combination of amino acid substitutions at two or more positions selected from: S78N-Q206F/M/Y, S78G-Q206D/F/H/M/N/P/R/Y, N18K/R-S78N, N18K/R-S87R, N18K/R-Q206L/Y, S24F/L/P/R-S87R, S24F/L/P-Q206L/Y, S24F/L/P/R-Q206Y, S24F/L/P-Y209W, P40E-S78G, P40E-S87R, P40E-P129Q, P40E-S130A, S78N-S87D/R, S78G-S87D/R/T, S78A/C/E/F/H/I/K/L/M/P/Q/R/T/V/W/-S87R, S78A/C/E/F/G/H/I/K/L/M/P/Q/R/T/V/W/Y-P129Q, S78A/C/E/F/H/I/K/L/M/P/Q/R/T/V/W/Y-S130A, S78G-S130A/Q, S78N-H249N/R, S87D/R-Q206L/R/Y, S87D/R-Y209W, S87D/R-T213A, S87R-H249N/R, P129Q-Q206RY, P129Q-H249N/R, S130A-Q206R/Y, S130A-H249N/R, Q206Y-Y209W, Q206L/Y-T213A, Q206L/Y-H249N/R, Y209W-T213A, Y209W-H249N/R, N18K/R-S24F/L/P-S78N, N18K/R-S24F/L/P/R-S87D/R, N18K/R-S24F/L/P/R-P129Q, N18K/R-S24F/L/P/R-S130A, N18K/R-S24F/L/P/R-Q206L/Y, N18K/R-S24F/L/P/R-Y209W, N18K/R-S78N-S87D/R, N18K/R-S78N-P129Q, N18K/R-S78N-S130A, N18K/R-S78N-Q206L/Y, N18K/R-S78N-Y209W, N18K/R-S78N-T213A, N18K/R-S78N-H249N/R, N18K/R-S87D/R-P129Q, N18K/R-S87D/R-S130A, N18K/R-S87D/R-Q206L/Y, N18K/R-S87D/R-Y209W, N18K/R-S87D/R-T213A, N18K/R-S87D/R-H249, N18K/R-P129Q-S130A, N18K/R-P129Q-Q206L/Y, N18K/R-P129Q-209, N18K/R-P129Q-T213A, N18K/R-P129Q-H249N/R, N18K/R-S130A-Q206L/Y, N18K/R-S130A-Y209W, N18K/R-S130A-T213A, N18K/R-S130A-H249N/R, N18K/R-Q206L/Y-Y209W, N18K/R-Q206L/Y-T213A, N18K/R-Q206L/Y-H249N/R, N18K/R-Y209W-T213A, N18K/R-Y209W-H249N/R, N18K/R-T213A-H249N/R, S24F/L/P/R-S78N-S87D/R, S24F/L/P-S78N-P129Q, S24F/L/P-S78N-S130A, S24F/L/P-S78N-Q206L/Y, S24F/L/P/R-S78N-Q206Y, S24F/L/P-S78N-Y209W, S24F/L/P/R-S78N-T213A, S24F/L/P/R-S78N-H249N/R, S24F/L/P/R-S87D/R-P129Q, S24F/L/P/R-S87D/R-S130A, S24F/L/P/R-S87D/R-Q206L/Y, S24F/L/P/R-87D/R-Y209W, S24F/L/P/R-S87D/R-T213A, S24F/L/P/R-S87D/R-H249, S24F/L/P-P129Q-S130A, S24F/L/P-P129Q-Q206L/Y, S24F/L/P/R-P129Q-Q206Y, S24F/L/P-P129Q-Y209W, S24F/L/P/R-P129Q-T213A, S24F/L/P/R-P129Q-H249N/R, S24F/L/P-S130A-Q206L/Y, S24F/L/P/R-S130A-Q206Y, S24F/L/P-S130A-Y209W, S24F/L/P/R-S130A-T213A, S24F/L/P/R-S130A-H249N/R, S24F/L/P-Q206L/Y-Y209W, S24F/L/P/R-Q206Y-Y209W, S24F/L/P/R-Q206L/Y-T213A, S24F/L/P/R-Q206L/Y-H249N/R, S24F/L/P/R-Y209W-T213A, S24F/L/P/R-Y209W-H249N/R, S78N-S87D/R-P129Q, S78N-S87D/R-S130A, S78N-S87D/R-Q206L/Y, S78N-S87D/R-Y209W, S78N-S87D/R-T213A, S78N-S87D/R-H249N/R, S78N-P129Q-Q206Y, S78N-P129Q-T213A, S78N-P129Q-H249N/R, S78N-S130A-Q206Y, S78N-S130A-T213A, S78N-S130A-H249N/R, S78N-Q206L/Y-T213A, S78N-Q206L/Y-H249N/R, S78N-Y209W-T213A, S78N-Y209W-H249N/R, S78N-T213A-H249N/R, S87D/R-P129Q-S130A, S87D/R-P129Q-Q206L/R/Y, S87D/R-P129Q-Y209W, S87D/R-P129Q-T213A, S87D/R-P129Q-H249N/R, S87D/R-S130A-Q206L/R/Y, S87D/R-S130A-Y209W, S87D/R-S130A-T213A, S87D/R-S130A-H249N/R, S87D/R-Q206L/Y-Y209W, S87D/R-Q206L/Y-T213A, 87D/R-Q206L/Y-H249N/R, S87D/R-Y209W-T213A, S87D/R-Y209W-H249N/R, S87D/R-T213A-H249N/R, P129Q-S130A-Q206R/Y, P129Q-S130A-T213A, P129Q-S130A-H249N/R, P129Q-Q206Y-Y209W, P129Q-Q206L/Y-T213A, P129Q-Q206L/Y-H249N/R, P129Q-Y209W-T213A, P129Q-Y209W-H249N/R, P129Q-T213A-H249N/R, S130A-Q206Y-Y209W, S130A-Q206L/Y-T213A, S130A-Q206L/Y-H249N/R, S130A-Y209W-T213A, S130A-Y209W-H249N/R, S130A-T213A-H249N/R, S130A-Y209W-H249N/R, Q206L/Y-Y209W-T213A, Q206L/Y-Y209W-H249N/R, Q206L/Y-T213A-H249N/R, Y209W-T213A-H249N/R, and combinations thereof, wherein said variant has proteolytic activity and the amino acid sequence of said variant further comprises one or more substitutions selected from: i) 1, 3, 8, 9, 16, 20, 22, 28, 42, 43, 44, 56, 76, 77, 82, 88, 100, 101, 103, 104, 108, 116, 118, 120, 124, 127, 128, 147, 150, 158, 159, 160, 166, 185, 194, 204, 210, 211, 212, 215, 216, 217, 218, 222, 232, 241, 245, 248, 251, 252, 254, 256, 259, 261, 262, 268, 270, 271; (ii) X1V, X3I/V, X8V, X9G, X16T, X20E/R, X22L/W, X28T, X42I, X43R/Y, X44V, X56P, X76D, X77D, X82D, X88S, X100S, X101G/H/Q/T/V, X103A, X104I, X108S, X116L/M, X118A/R/V, X120R, X124M, X127S/T, X128K/L/R, X147I, X150T, X158E/V, X160Q, X166D/N, X185Y, X194D/P, X204D, X210I, X211P, X212D, X215K/V, X216Y, X217K, X218S, X222Q/S, X232V, X241K, X245R, X248D, X251R, X252I, X254T, X256P, X259G, X261I, X262Q, X268A, X270P, and X271D; or (iii) A1V, S3I/V, I8V, S9G, A16T, G20E/R, T22L/W, V28T, L42I, N43R/Y, I44V, S56P, N76D, N77D, L82D, A88S, G100S, S101G/H/Q/T/V, S103A, V104I, A108S, N116L/M, G118A/R/V, H120R, L124M, G127S/T, S128K/LR, V147I, V150T, A158E/V, S160Q, S166D/N, N185Y, A194D/P, N204D, P210I, G211P, S212D, A215K/V, S216Y, L217K, N218S, M222Q/S, A232V, W241K, Q245R, N248D, K251R, N252I, A254T, S256P, S259G, N261I, L262Q, V268A, A270P, and E271D; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. An even still further embodiment provides an isolated subtilisin variant comprising a combination of amino acid substitutions at two or more positions selected from: S78N-Q206F/M/Y, S78G-Q206D/F/H/M/N/P/R/Y, N18K/R-S78N, N18K/R-S87R, N18K/R-Q206L/Y, S24F/L/P/R-S87R, S24F/L/P-Q206L/Y, S24F/L/P/R-Q206Y, S24F/L/P-Y209W, P40E-S78G, P40E-S87R, P40E-P129Q, P40E-S130A, S78N-S87D/R, S78G-S87D/R/T, S78A/C/E/F/H/I/K/L/M/P/Q/R/T/V/W/Y-S87R, S78A/C/E/F/G/H/I/K/L/M/P/Q/R/T/V/W/Y-P129Q, S78A/C/E/F/H/I/K/L/M/P/Q/R/T/V/W/Y-S130A, S78G-S130A/Q, S78N-H249N/R, S87D/R-Q206L/R/Y, S87D/R-Y209W, S87D/R-T213A, S87R-H249N/R, P129Q-Q206RY, P129Q-H249N/R, S130A-Q206R/Y, S130A-H249N/R, Q206Y-Y209W, Q206L/Y-T213A, Q206L/Y-H249N/R, Y209W-T213A, Y209W-H249N/R, N18K/R-S24F/L/P-S78N, N18K/R-S24F/L/P/R-S87D/R, N18K/R-S24F/L/P/R-P129Q, N18K/

R-S24F/L/P/R-S130A, N18K/R-S24F/L/P/R-Q206L/Y, N18K/R-S24F/L/P/R-Y209W, N18K/R-S78N-S87D/R, N18K/R-S78N-P129Q, N18K/R-S78N-S130A, N18K/R-S78N-Q206L/Y, N18K/R-S78N-Y209W, N18K/R-S78N-T213A, N18K/R-S78N-H249N/R, N18K/R-S87D/R-P129Q, N18K/R-S87D/R-S130A, N18K/R-S87D/R-Q206L/Y, N18K/R-S87D/R-Y209W, N18K/R-S87D/R-T213A, N18K/R-S87D/R-H249, N18K/R-P129Q-S130A, N18K/R-P129Q-Q206L/Y, N18K/R-P129Q-209, N18K/R-P129Q-T213A, N18K/R-P129Q-H249N/R, N18K/R-S130A-Q206L/Y, N18K/R-S130A-Y209W, N18K/R-S130A-T213A, N18K/R-S130A-H249N/R, N18K/R-Q206L/Y-Y209W, N18K/R-Q206L/Y-T213A, N18K/R-Q206L/Y-H249N/R, N18K/R-Y209W-T213A, N18K/R-Y209W-H249N/R, N18K/R-T213A-H249N/R, S24F/L/P/R-S78N-S87D/R, S24F/L/P-S78N-P129Q, S24F/L/P-S78N-S130A, S24F/L/P-S78N-Q206L/Y, S24F/L/P/R-S78N-Q206Y, S24F/L/P-S78N-Y209W, S24F/L/P/R-S78N-T213A, S24F/L/P/R-S78N-H249N/R, S24F/L/P/R-S87D/R-P129Q, S24F/L/P/R-S87D/R-S130A, S24F/L/P/R-S87D/R-Q206L/Y, S24F/L/P/R-87D/R-Y209W, S24F/L/P/R-S87D/R-T213A, S24F/L/P/R-S87D/R-H249, S24F/L/P-P129Q-S130A, S24F/L/P-P129Q-Q206L/Y, S24F/L/P/R-P129Q-Q206Y, S24F/L/P-P129Q-Y209W, S24F/L/P/R-P129Q-T213A, S24F/L/P/R-P129Q-H249N/R, S24F/L/P-S130A-Q206L/Y, S24F/L/P/R-S130A-Q206Y, S24F/L/P-S130A-Y209W, S24F/L/P/R-S130A-T213A, S24F/L/P/R-S130A-H249N/R, S24F/L/P-Q206L/Y-Y209W, S24F/L/P/R-Q206Y-Y209W, S24F/L/P/R-Q206L/Y-T213A, S24F/L/P/R-Q206L/Y-H249N/R, S24F/L/P/R-Y209W-T213A, S24F/L/P/R-Y209W-H249N/R, S78N-S87D/R-P129Q, S78N-S87D/R-S130A, S78N-S87D/R-Q206L/Y, S78N-S87D/R-Y209W, S78N-S87D/R-T213A, S78N-S87D/R-H249N/R, S78N-P129Q-Q206Y, S78N-P129Q-T213A, S78N-P129Q-H249N/R, S78N-S130A-Q206Y, S78N-S130A-T213A, S78N-S130A-H249N/R, S78N-Q206L/Y-T213A, S78N-Q206L/Y-H249N/R, S78N-Y209W-T213A, S78N-Y209W-H249N/R, S78N-T213A-H249N/R, S87D/R-P129Q-S130A, S87D/R-P129Q-Q206L/R/Y, S87D/R-P129Q-Y209W, S87D/R-P129Q-T213A, S87D/R-P129Q-H249N/R, S87D/R-S130A-Q206L/R/Y, S87D/R-S130A-Y209W, S87D/R-S130A-T213A, S87D/R-S130A-H249N/R, S87D/R-Q206L/Y-Y209W, S87D/R-Q206L/Y-T213A, 87D/R-Q206L/Y-H249N/R, S87D/R-Y209W-T213A, S87D/R-Y209W-H249N/R, S87D/R-T213A-H249N/R, P129Q-S130A-Q206R/Y, P129Q-S130A-T213A, P129Q-S130A-H249N/R, P129Q-Q206Y-Y209W, P129Q-Q206L/Y-T213A, P129Q-Q206L/Y-H249N/R, P129Q-Y209W-T213A, P129Q-Y209W-H249N/R, P129Q-T213A-H249N/R, S130A-Q206Y-Y209W, S130A-Q206L/Y-T213A, S130A-Q206L/Y-H249N/R, S130A-Y209W-T213A, S130A-Y209W-H249N/R, S130A-T213A-H249N/R, S130A-Y209W-H249N/R, Q206L/Y-Y209W-T213A, Q206L/Y-Y209W-H249N/R, Q206L/Y-T213A-H249N/R, Y209W-T213A-H249N/R, and combinations thereof, wherein said variant has proteolytic activity and the amino acid sequence of said variant further comprises one or more substitutions selected from: (i) 3, 76, 101, 103, 104, 118, 127, 128, 166, 210, 217, 222, and 261; (ii) X3V X76D, X101F/G/V, X103A/D/P, X104I, X118R, X127T, X128L/R, X166D/N, X210I, X217K, X222Q/S, and X261I; or (ii) S3V, N76D, S101F/G/V, S103A/D/P, V104I, GI18R, G127T, S128L/R, S166D/N, P210I, L217K, M222Q/S, and N261I; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence.

A yet even further embodiment provides an isolated subtilisin variant comprising a combination of amino acid substitutions at two or more positions selected from: S78N-Q206L/Y, N18K/R-S78N, N18K/R-S87R, N18K/R-Q206L/Y, S24F/P/R-S87R, S24F/P/R-Q206L/Y, S24F/P/R-Q206L/Y, S24F/P/R-Y209W, S78N-S87D/R, S78N-P129Q, S78N-S130A, S78N-Y209W, S78N-H249N/R, S78N-H249N/R, S87D/R-Q206L/Y, S87D/R-Y209W, S87D/R-T213A, S87R-H249N/R, P129Q-Q206L/Y, P129Q-Y209W, P129Q-H249N/R, S130A-Q206L/Y, S130A-Y209W, S130A-H249N/R, Q206L/Y-Y209W, Q206L/Y-T213A, Q206L/Y-H249N/R, Y209W-T213A, Y209W-H249N/R, N18K/R-S24F/P/R-S78N, N18K/R-S24F/P/R-S87D/R, N18K/R-S24F/P/R-P129Q, N18K/R-S24F/P/R-S130A, N18K/R-S24F/P/R-Q206L/Y, N18K/R-S24F/P/R-Y209W, N18K/R-S78N-S87D/R, N18K/R-S78N-P129Q, N18K/R-S78N-S130A, N18K/R-S78N-Q206L/Y, N18K/R-S78N-Y209W, N18K/R-S78N-T213A, N18K/R-S78N-H249N/R, N18K/R-S87D/R-P129Q, N18K/R-S87D/R-S130A, N18K/R-S87D/R-Q206L/Y, N18K/R-S87D/R-Y209W, N18K/R-S87D/R-T213A, N18K/R-S87D/R-H249, N18K/R-P129Q-S130A, N18K/R-P129Q-Q206L/Y, N18K/R-P129Q-209, N18K/R-P129Q-T213A, N18K/R-P129Q-H249N/R, N18K/R-S130A-Q206L/Y, N18K/R-S130A-Y209W, N18K/R-S130A-T213A, N18K/R-S130A-H249N/R, N18K/R-Q206L/Y-Y209W, N18K/R-Q206L/Y-T213A, N18K/R-Q206L/Y-H249N/R, N18K/R-Y209W-T213A, N18K/R-Y209W-H249N/R, N18K/R-T213A-H249N/R, S24F/P/R-S78N-S87D/R, S24F/P/R-S78N-P129Q, S24F/P/R-S78N-S130A, S24F/P/R-S78N-Q206L/Y, S24F/P/R-S78N-Y209W, S24F/P/R-S78N-T213A, S24F/P/R-S78N-H249N/R, S24F/P/R-S87D/R-P129Q, S24F/P/R-S87D/R-S130A, S24F/P/R-S87D/R-Q206L/Y, S24F/P/R-87D/R-Y209W, S24F/P/R-S87D/R-T213A, S24F/P/R-S87D/R-H249, S24F/P/R-P129Q-S130A, S24F/P/R-P129Q-Q206L/Y, S24F/P/R-P129Q-Y209W, S24F/P/R-P129Q-T213A, S24F/P/R-P129Q-H249N/R, S24F/P/R-S130A-Q206L/Y, S24F/P/R-S130A-Y209W, S24F/P/R-S130A-T213A, S24F/P/R-S130A-H249N/R, S24F/P/R-Q206L/Y-Y209W, S24F/P/R-Q206L/Y-T213A, S24F/P/R-Q206L/Y-H249N/R, S24F/P/R-Y209W-T213A, S24F/P/R-Y209W-H249N/R, S78N-S87D/R-P129Q, S78N-S87D/R-S130A, S78N-S87D/R-Q206L/Y, S78N-S87D/R-Y209W, S78N-S87D/R-T213A, S78N-S87D/R-H249N/R, S78N-P129Q-S130A, S78N-P129Q-Q206L/Y, S78N-P129Q-Y209W, S78N-P129Q-T213A, S78N-P129Q-H249N/R, S78N-S130A-Q206L/Y, S78N-S130A-Y209W, S78N-S130A-T213A, S78N-S130A-T213A, S78N-S130A-H249N/R, S78N-Q206L/Y-T213A, S78N-Q206L/Y-H249N/R, S78N-Y209W-T213A, S78N-Y209W-H249N/R, S78N-T213A-H249N/R, S87D/R-P129Q-S130A, S87D/R-P129Q-Q206L/Y, S87D/R-P129Q-Y209W, S87D/R-P129Q-T213A, S87D/R-P129Q-H249N/R, S87D/R-S130A-Q206L/Y, S87D/R-S130A-Y209W, S87D/R-S130A-T213A, S87D/R-S130A-H249N/R, S87D/R-Q206L/Y-Y209W, S87D/R-Q206L/Y-T213A, 87D/R-Q206L/Y-H249N/R, S87D/R-Y209W-T213A, S87D/R-Y209W-H249N/R, S87D/R-T213A-H249N/R, P129Q-S130A-Q206L/Y, P129Q-S130A-Y209W, P129Q-S130A-T213A, P129Q-S130A-H249N/R, P129Q-Q206L/Y-Y209W, P129Q-Q206L/Y-T213A, P129Q-Q206L/Y-H249N/R, P129Q-Y209W-T213A, P129Q-Y209W-H249N/R, P129Q-T213A-H249N/R, S130A-Q206L/Y-Y209W, S130A-Q206L/Y-T213A, S130A-Q206L/Y-H249N/R, S130A-

Y209W-T213A, S130A-Y209W-H249N/R, S130A-T213A-H249N/R, S130A-Y209W-H249N/R, Q206L/Y-Y209W-T213A, Q206L/Y-Y209W-H249N/R, Q206L/Y-T213A-H249N/R, Y209W-T213A-H249N/R, and combinations thereof; wherein said variant has proteolytic activity and each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. Another embodiment provides an isolated subtilisin variant comprising a combination of amino acid substitutions at two or more positions selected from: S78N-Q206L/Y, N18K/R-S78N, N18K/R-S87R, N18K/R-Q206L/Y, S24F/P/R-S87R, S24F/P/R-Q206L/Y, S24F/P/R-Q206L/Y, S24F/P/R-Y209W, S78N-S87D/R, S78N-P129Q, S78N-S130A, S78N-Y209W, S78N-H249N/R, S78N-H249N/R, S87D/R-Q206L/Y, S87D/R-Y209W, S87D/R-T213A, S87R-H249N/R, P129Q-Q206L/Y, P129Q-Y209W, P129Q-H249N/R, S130A-Q206L/Y, S130A-Y209W, S130A-H249N/R, Q206L/Y-Y209W, Q206L/Y-T213A, Q206L/Y-H249N/R, Y209W-T213A, Y209W-H249N/R, N18K/R-S24F/P/R-S78N, N18K/R-S24F/P/R-S87D/R, N18K/R-S24F/P/R-P129Q, N18K/R-S24F/P/R-S130A, N18K/R-S24F/P/R-Q206L/Y, N18K/R-S24F/P/R-Y209W, N18K/R-S78N-S87D/R, N18K/R-S78N-P129Q, N18K/R-S78N-S130A, N18K/R-S78N-Q206L/Y, N18K/R-S78N-Y209W, N18K/R-S78N-T213A, N18K/R-S78N-H249N/R, N18K/R-S87D/R-P129Q, N18K/R-S87D/R-S130A, N18K/R-S87D/R-Q206L/Y, N18K/R-S87D/R-Y209W, N18K/R-S87D/R-T213A, N18K/R-S87D/R-H249, N18K/R-P129Q-S130A, N18K/R-P129Q-Q206L/Y, N18K/R-P129Q-209, N18K/R-P129Q-T213A, N18K/R-P129Q-H249N/R, N18K/R-S130A-Q206L/Y, N18K/R-S130A-Y209W, N18K/R-S130A-T213A, N18K/R-S130A-H249N/R, N18K/R-Q206L/Y-Y209W, N18K/R-Q206L/Y-T213A, N18K/R-Q206L/Y-H249N/R, N18K/R-Y209W-T213A, N18K/R-Y209W-H249N/R, N18K/R-T213A-H249N/R, S24F/P/R-S78N-S87D/R, S24F/P/R-S78N-P129Q, S24F/P/R-S78N-S130A, S24F/P/R-S78N-Q206L/Y, S24F/P/R-S78N-Y209W, S24F/P/R-S78N-T213A, S24F/P/R-S78N-H249N/R, S24F/P/R-S87D/R-P129Q, S24F/P/R-S87D/R-S130A, S24F/P/R-S87D/R-Q206L/Y, S24F/P/R-87D/R-Y209W, S24F/P/R-S87D/R-T213A, S24F/P/R-S87D/R-H249, S24F/P/R-P129Q-S130A, S24F/P/R-P129Q-Q206L/Y, S24F/P/R-P129Q-Y209W, S24F/P/R-P129Q-T213A, S24F/P/R-P129Q-H249N/R, S24F/P/R-S130A-Q206L/Y, S24F/P/R-S130A-Y209W, S24F/P/R-S130A-T213A, S24F/P/R-S130A-H249N/R, S24F/P/R-Q206L/Y-Y209W, S24F/P/R-Q206L/Y-T213A, S24F/P/R-Q206L/Y-H249N/R, S24F/P/R-Y209W-T213A, S24F/P/R-Y209W-H249N/R, S78N-S87D/R-P129Q, S78N-S87D/R-S130A, S78N-S87D/R-Q206L/Y, S78N-S87D/R-Y209W, S78N-S87D/R-T213A, S78N-S87D/R-H249N/R, S78N-P129Q-S130A, S78N-P129Q-Q206L/Y, S78N-P129Q-Y209W, S78N-P129Q-T213A, S78N-P129Q-H249N/R, S78N-S130A-Q206L/Y, S78N-S130A-Y209W, S78N-S130A-T213A, S78N-S130A-T213A, S78N-S130A-H249N/R, S78N-Q206L/Y-T213A, S78N-Q206L/Y-H249N/R, S78N-Y209W-T213A, S78N-Y209W-H249N/R, S78N-T213A-H249N/R, S87D/R-P129Q-S130A, S87D/R-P129Q-Q206L/Y, S87D/R-P129Q-Y209W, S87D/R-P129Q-T213A, S87D/R-P129Q-H249N/R, S87D/R-S130A-Q206L/Y, S87D/R-S130A-Y209W, S87D/R-S130A-T213A, S87D/R-S130A-H249N/R, S87D/R-Q206L/Y-Y209W, S87D/R-Q206L/Y-T213A, 87D/R-Q206L/Y-H249N/R, S87D/R-Y209W-T213A, S87D/R-Y209W-H249N/R, S87D/R-T213A-H249N/R, P129Q-S130A-Q206L/Y, P129Q-S130A-Y209W, P129Q-S130A-T213A, P129Q-S130A-H249N/R, P129Q-Q206L/Y-Y209W, P129Q-Q206L/Y-T213A, P129Q-Q206L/Y-H249N/R, P129Q-Y209W-T213A, P129Q-Y209W-H249N/R, P129Q-T213A-H249N/R, S130A-Q206L/Y-Y209W, S130A-Q206L/Y-T213A, S130A-Q206L/Y-H249N/R, S130A-Y209W-T213A, S130A-Y209W-H249N/R, S130A-T213A-H249N/R, S130A-Y209W-H249N/R, Q206L/Y-Y209W-T213A, Q206L/Y-Y209W-H249N/R, Q206L/Y-T213A-H249N/R, Y209W-T213A-H249N/R, and combinations thereof, wherein said variant has proteolytic activity and the amino acid sequence of said variant further comprises one or more substitutions selected from: (i) 1, 3, 9, 16, 20, 22, 28, 42, 43, 44, 56, 76, 77, 99, 100, 101, 103, 104, 108, 116, 118, 120, 124, 127, 128, 150, 158, 159, 166, 185, 188, 194, 204, 212, 217, 218, 222, 232, 235, 243, 245, 246, 251, 254, 259, 268, and 270, (ii) X1V, X3T/V, X9G, X16T, X20E/R, X22L, X28T, X42I, X43R/S, X44V, X56P, X76D, X77D, X99N, X100S, X101F/G/H/T/V, X103A/D/P, X104I, X108S, X116L/M, X118R/V, X120R, X124M, X127T, X128L, X150T, X158E/T/V, X159D, X166D/N, X185Y, X188D, X194D, X204D, X212D, X217K, X218S, X222L/Q/S, X232V, X235T, X243S, X245R, X246V, X251R, X254T, X259G, X268A, and X270P/T, or (iii) A1V, S3T/V, S9G, A16T, G20E/R, T22L, V28T, L42I, N43R/S, I44V, S56P, N76D, N77D, S99N, G100S, S101F/G/H/T/V, S103A/D/P, V104I, A108S, N116L/M, GI18R/V, H120R, L124M, G127T, S128L, V150T, A158E/T/V, G159D, S166D/N, N185Y, S188D, A194D, N204D, S212D, L217K, N218S, M222L/Q/S, A232V, K235T, N243S, Q245R, I246V, K251R, A254T, S259G, V268A, and A270P/T; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. Yet another embodiment provides an isolated subtilisin variant comprising a combination of amino acid substitutions at two or more positions selected from: S78N-Q206L/Y, N18K/R-S78N, N18K/R-S87R, N18K/R-Q206L/Y, S24F/P/R-S87R, S24F/P/R-Q206L/Y, S24F/P/R-Q206L/Y, S24F/P/R-Y209W, S78N-S87D/R, S78N-P129Q, S78N-S130A, S78N-Y209W, S78N-H249N/R, S78N-H249N/R, S87D/R-Q206L/Y, S87D/R-Y209W, S87D/R-T213A, S87R-H249N/R, P129Q-Q206L/Y, P129Q-Y209W, P129Q-H249N/R, S130A-Q206L/Y, S130A-Y209W, S130A-H249N/R, Q206L/Y-Y209W, Q206L/Y-T213A, Q206L/Y-H249N/R, Y209W-T213A, Y209W-H249N/R, N18K/R-S24F/P/R-S78N, N18K/R-S24F/P/R-S87D/R, N18K/R-S24F/P/R-P129Q, N18K/R-S24F/P/R-S130A, N18K/R-S24F/P/R-Q206L/Y, N18K/R-S24F/P/R-Y209W, N18K/R-S78N-S87D/R, N18K/R-S78N-P129Q, N18K/R-S78N-S130A, N18K/R-S78N-Q206L/Y, N18K/R-S78N-Y209W, N18K/R-S78N-T213A, N18K/R-S78N-H249N/R, N18K/R-S87D/R-P129Q, N18K/R-S87D/R-S130A, N18K/R-S87D/R-Q206L/Y, N18K/R-S87D/R-Y209W, N18K/R-S87D/R-T213A, N18K/R-S87D/R-H249, N18K/R-P129Q-S130A, N18K/R-P129Q-Q206L/Y, N18K/R-P129Q-209, N18K/R-P129Q-T213A, N18K/R-P129Q-H249N/R, N18K/R-S130A-Q206L/Y, N18K/R-S130A-Y209W, N18K/R-S130A-T213A, N18K/R-S130A-H249N/R, N18K/R-Q206L/Y-Y209W, N18K/R-Q206L/Y-T213A, N18K/R-Q206L/Y-H249N/R, N18K/R-Y209W-T213A, N18K/R-Y209W-H249N/R, N18K/R-T213A-H249N/R, S24F/P/R-S78N-S87D/R, S24F/P/R-S78N-P129Q, S24F/P/R-S78N-S130A, S24F/P/R-S78N-Q206L/Y, S24F/P/R-S78N-Y209W, S24F/P/R-S78N-T213A, S24F/

P/R-S78N-H249N/R, S24F/P/R-S87D/R-P129Q, S24F/P/R-S87D/R-S130A, S24F/P/R-S87D/R-Q206L/Y, S24F/P/R-87D/R-Y209W, S24F/P/R-S87D/R-T213A, S24F/P/R-S87D/R-H249, S24F/P/R-P129Q-S130A, S24F/P/R-P129Q-Q206L/Y, S24F/P/R-P129Q-Y209W, S24F/P/R-P129Q-T213A, S24F/P/R-P129Q-H249N/R, S24F/P/R-S130A-Q206L/Y, S24F/P/R-S130A-Y209W, S24F/P/R-S130A-T213A, S24F/P/R-S130A-H249N/R, S24F/P/R-Q206L/Y-Y209W, S24F/P/R-Q206L/Y-T213A, S24F/P/R-Q206L/Y-H249N/R, S24F/P/R-Y209W-T213A, S24F/P/R-Y209W-H249N/R, S78N-S87D/R-P129Q, S78N-S87D/R-S130A, S78N-S87D/R-Q206L/Y, S78N-S87D/R-Y209W, S78N-S87D/R-T213A, S78N-S87D/R-H249N/R, S78N-P129Q-S130A, S78N-P129Q-Q206L/Y, S78N-P129Q-Y209W, S78N-P129Q-T213A, S78N-P129Q-H249N/R, S78N-S130A-Q206L/Y, S78N-S130A-Y209W, S78N-S130A-T213A, S78N-S130A-T213A, S78N-S130A-H249N/R, S78N-Q206L/Y-T213A, S78N-Q206L/Y-H249N/R, S78N-Y209W-T213A, S78N-Y209W-H249N/R, S78N-T213A-H249N/R, S87D/R-P129Q-S130A, S87D/R-P129Q-Q206L/Y, S87D/R-P129Q-Y209W, S87D/R-P129Q-T213A, S87D/R-P129Q-H249N/R, S87D/R-S130A-Q206L/Y, S87D/R-S130A-Y209W, S87D/R-S130A-T213A, S87D/R-S130A-H249N/R, S87D/R-Q206L/Y-Y209W, S87D/R-Q206L/Y-T213A, 87D/R-Q206L/Y-H249N/R, S87D/R-Y209W-T213A, S87D/R-Y209W-H249N/R, S87D/R-T213A-H249N/R, P129Q-S130A-Q206L/Y, P129Q-S130A-Y209W, P129Q-S130A-T213A, P129Q-S130A-H249N/R, P129Q-Q206L/Y-Y209W, P129Q-Q206L/Y-T213A, P129Q-Q206L/Y-H249N/R, P129Q-Y209W-T213A, P129Q-Y209W-H249N/R, P129Q-T213A-H249N/R, S130A-Q206L/Y-Y209W, S130A-Q206L/Y-T213A, S130A-Q206L/Y-H249N/R, S130A-Y209W-T213A, S130A-Y209W-H249N/R, S130A-T213A-H249N/R, S130A-Y209W-H249N/R, Q206L/Y-Y209W-T213A, Q206L/Y-Y209W-H249N/R, Q206L/Y-T213A-H249N/R, Y209W-T213A-H249N/R, and combinations thereof; wherein said variant has proteolytic activity and the amino acid sequence of said variant further comprises one or more substitutions selected from: (i) 3, 28, 43, 76, 99, 100, 101, 103, 104, 108, 116, 118, 124, 127, 128, 150, 158, 159, 166, 188, 194, 212, 217, 222, 232, 235, 243, 245, 246, and 270, (ii) X3T/V, X28T, X43S, X76D, X99N, X100S, X101F/G/V, X103A/D/P, X104I, X108S, X116M, X118R, X124M, X127T, X128L, X150T, X158E/T, X159D, X166D, X188D, X194D, X212D, X217K, X222Q/S, X232V, X235T, X243S, X245R, X246V, and X270T, or (iii) S3V/T, V28T, N43S, N76D, S99N, G100S, S101F/G/V, S103A/D/P, V104I, A108S, N116M, G118R, L124M, G127T, S128L, V150T, A158E/T, G159D, S166D, S188D, A194D, S212D, L217K, M222Q/S, A232V, K235T, N243S, Q245R, I246V, and A270T; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. Yet still another embodiment provides an isolated subtilisin variant comprising a combination of amino acid substitutions at two or more positions selected from: S78N-Q206L/Y, N18K/R-S78N, N18K/R-S87R, N18K/R-Q206L/Y, S24F/P/R-S87R, S24F/P/R-Q206L/Y, S24F/P/R-Q206L/Y, S24F/P/R-Y209W, S78N-S87D/R, S78N-P129Q, S78N-S130A, S78N-Y209W, S78N-H249N/R, S78N-H249N/R, S78N-Q206L/Y, S87D/R-Y209W, S87D/R-T213A, S87R-H249N/R, P129Q-Q206L/Y, P129Q-Y209W, P129Q-H249N/R, S130A-Q206L/Y, S130A-Y209W, S130A-H249N/R, Q206L/Y-Y209W, Q206L/Y-T213A, Q206L/Y-H249N/R, Y209W-T213A, Y209W-H249N/R, N18K/R-S24F/P/R-S78N, N18K/R-S24F/P/R-S87D/R, N18K/R-S24F/P/R-P129Q, N18K/R-S24F/P/R-S130A, N18K/R-S24F/P/R-Q206L/Y, N18K/R-S24F/P/R-Y209W, N18K/R-S78N-S87D/R, N18K/R-S78N-P129Q, N18K/R-S78N-S130A, N18K/R-S78N-Q206L/Y, N18K/R-S78N-Y209W, N18K/R-S78N-T213A, N18K/R-S78N-H249N/R, N18K/R-S87D/R-P129Q, N18K/R-S87D/R-S130A, N18K/R-S87D/R-Q206L/Y, N18K/R-S87D/R-Y209W, N18K/R-S87D/R-T213A, N18K/R-S87D/R-H249, N18K/R-P129Q-S130A, N18K/R-P129Q-Q206L/Y, N18K/R-P129Q-209, N18K/R-P129Q-T213A, N18K/R-P129Q-H249N/R, N18K/R-S130A-Q206L/Y, N18K/R-S130A-Y209W, N18K/R-S130A-T213A, N18K/R-S130A-H249N/R, N18K/R-Q206L/Y-Y209W, N18K/R-Q206L/Y-T213A, N18K/R-Q206L/Y-H249N/R, N18K/R-Y209W-T213A, N18K/R-Y209W-H249N/R, N18K/R-T213A-H249N/R, S24F/P/R-S78N-S87D/R, S24F/P/R-S78N-P129Q, S24F/P/R-S78N-S130A, S24F/P/R-S78N-Q206L/Y, S24F/P/R-S78N-Y209W, S24F/P/R-S78N-T213A, S24F/P/R-S78N-H249N/R, S24F/P/R-S87D/R-P129Q, S24F/P/R-S87D/R-S130A, S24F/P/R-S87D/R-Q206L/Y, S24F/P/R-87D/R-Y209W, S24F/P/R-S87D/R-T213A, S24F/P/R-S87D/R-H249, S24F/P/R-P129Q-S130A, S24F/P/R-P129Q-Q206L/Y, S24F/P/R-P129Q-Y209W, S24F/P/R-P129Q-T213A, S24F/P/R-P129Q-H249N/R, S24F/P/R-S130A-Q206L/Y, S24F/P/R-S130A-Y209W, S24F/P/R-S130A-T213A, S24F/P/R-S130A-H249N/R, S24F/P/R-Q206L/Y-Y209W, S24F/P/R-Q206L/Y-T213A, S24F/P/R-Q206L/Y-H249N/R, S24F/P/R-Y209W-T213A, S24F/P/R-Y209W-H249N/R, S78N-S87D/R-P129Q, S78N-S87D/R-S130A, S78N-S87D/R-Q206L/Y, S78N-S87D/R-Y209W, S78N-S87D/R-T213A, S78N-S87D/R-H249N/R, S78N-P129Q-S130A, S78N-P129Q-Q206L/Y, S78N-P129Q-Y209W, S78N-P129Q-T213A, S78N-P129Q-H249N/R, S78N-S130A-Q206L/Y, S78N-S130A-Y209W, S78N-S130A-T213A, S78N-S130A-T213A, S78N-S130A-H249N/R, S78N-Q206L/Y-T213A, S78N-Q206L/Y-H249N/R, S78N-Y209W-T213A, S78N-Y209W-H249N/R, S78N-T213A-H249N/R, S87D/R-P129Q-S130A, S87D/R-P129Q-Q206L/Y, S87D/R-P129Q-Y209W, S87D/R-P129Q-T213A, S87D/R-P129Q-H249N/R, S87D/R-S130A-Q206L/Y, S87D/R-S130A-Y209W, S87D/R-S130A-T213A, S87D/R-S130A-H249N/R, S87D/R-Q206L/Y-Y209W, S87D/R-Q206L/Y-T213A, 87D/R-Q206L/Y-H249N/R, S87D/R-Y209W-T213A, S87D/R-Y209W-H249N/R, S87D/R-T213A-H249N/R, P129Q-S130A-Q206L/Y, P129Q-S130A-Y209W, P129Q-S130A-T213A, P129Q-S130A-H249N/R, P129Q-Q206L/Y-Y209W, P129Q-Q206L/Y-T213A, P129Q-Q206L/Y-H249N/R, P129Q-Y209W-T213A, P129Q-Y209W-H249N/R, P129Q-T213A-H249N/R, S130A-Q206L/Y-Y209W, S130A-Q206L/Y-T213A, S130A-Q206L/Y-H249N/R, S130A-Y209W-T213A, S130A-Y209W-H249N/R, S130A-T213A-H249N/R, S130A-Y209W-H249N/R, Q206L/Y-Y209W-T213A, Q206L/Y-Y209W-H249N/R, Q206L/Y-T213A-H249N/R, Y209W-T213A-H249N/R, and combinations thereof, wherein said variant has proteolytic activity and the amino acid sequence of said variant further comprises one or more substitutions selected from: (i) 76, 101, 103, 104, 118, 127, 128, 166, and 222, (ii) X76D, X101F/G/V, X103A/D/P, X104I, X118R, X127T, X128L, X166D/N and X222Q/S, or (iii) N76D, S101F/G/V, S103A/D/P, V104I, G118R, G127T, S128L, S166D/N, and M222Q/S; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. Another embodiment provides an isolated subtilisin variant comprising an amino acid sequence comprising two or more substitutions selected from: (i) 3-8, 3-40, 3-78, 3-87, 3-118, 3-128, 3-129, 3-130, 3-210, 3-211, 3-215, 3-217, 3-261, 3-262, 8-40, 8-76, 8-87, 8-118, 8-128, 8-210, 8-215, 8-261, 18-78, 18-87, 18-118, 18-206, 24-87, 24-206, 24-209, 24-213, 24-222, 40-76, 40-87, 40-118, 40-128, 40-210, 40-215, 40-217, 40-261, 76-210, 76-211, 76-213, 76-215, 76-217, 76-249, 76-261, 76-262, 78-87, 78-118, 78-210, 78-213, 78-222, 78-249, 87-206, 87-209, 87-213, 87-215, 87-217, 87-222, 87-249, 87-261, 118-206, 118-209, 118-210, 118-211, 118-213, 118-215, 118-217, 118-222, 118-249, 118-261, 118-262, 128-209, 128-210, 128-215, 128-217, 128-261, 129-206, 129-209, 130-206, 130-209, 206-213, 206-249, 209-213, 209-249, 210-217, 210-261, 213-222, 213-249, 215-261, 222-249, and combinations thereof, (ii) 3-76-118, 18-24-206, 18-24-209, 18-24-213, 18-24-249, 18-87-209, 18-118-209, 18-206-209, 18-209-213, 18-209-222, 18-209-249, 18-213-249, 24-76-78, 24-76-87, 24-76-118, 24-76-209, 24-76-222, 24-76-249, 24-78-87, 24-78-118, 24-78-206, 24-78-209, 24-78-222, 24-78-249, 24-87-118, 24-87-209, 24-87-222, 24-87-249, 24-118-209, 24-118-222, 24-118-249, 24-206-209, 24-206-249, 24-209-213, 24-209-222, 24-209-249, 24-213-249, 24-222-249, 76-78-118, 76-78-87, 76-78-129, 76-78-130, 76-78-206, 76-78-209, 76-78-222, 76-78-249, 76-87-118, 76-87-206, 76-87-209, 76-87-249, 76-118-128, 76-118-206, 76-118-209, 76-118-222, 76-118-249, 76-209-222, 76-209-249, 78-87-118, 78-87-129, 78-87-130, 78-87-206, 78-87-209, 78-87-222, 78-87-249, 78-118-129, 78-118-209, 78-118-222, 78-118-249, 78-129-130, 78-209-222, 78-209-249, 78-222-249, 87-118-206, 87-118-209, 87-118-249, 87-206-209, 87-209-222, 87-209-249, 87-222-249, 118-209-213, 118-209-222, 118-209-249, 118-222-249, 206-209-249, 209-213-222, 209-213-249, 209-222-249, and combinations thereof, (iii) X3V-X8V, X3V-X40E, X3V-X78G/N, X3V-X87D, X3V-X118R, X3V-X128R, X3V-X129Q, X3V-X130A, X3V-X210I, X3V-X211P, X3V-X215K, X3V-X217K, X3V-X261I, X3V-X262Q, X8V-X40E, X8V-X76D, X8V-X87D, X8V-X118R, X8V-X128R, X8V-X210I, X8V-X215K, X8V-X261I, X18R-X78N, X18R-X87R, X18R-X118R, X18R-X206L, X24R-S78N, X24R-X87D/R, X24R-X206L/Y, X24R-X209W, X24R-X213A, X24R-X222Q, X40E-X76D, X40E-X87D/R, X40E-X118R, X40E-X128R, X40E-X210I, X40E-X215K, X40E-X217K, X40E-X261I, X76D-X87D, X76D-X128R, X76D-X206F/R/M/Y, X76D-X210I, X76D-X211P, X76D-X213A, X76D-X215K, X76D-X217K, X76D-X249R, X76D-X261I, X76D-X262Q, X78G-X206F/L/M/Y, X78G-X210I, X78G-X261I, X78G/N-X87D/R, X78G/N-X118R, X78G/N-X128L, X78G/N-X129Q, X78G/N-X130A, X78N-X213A, X78N-X222Q, X78N-X249R, X87D-X118R, X87D-X128L/R, X87D-X129Q, X87D-X130A, X87D/R-X209W, X87D-X210I, X87D-X215K, X87D-X217K, X87D/R-X222Q, X87D/R-X249R, X87R-X206F/L/M/R/Y, X87R-X213A, X87D/R-X261I, X118R-X128R, X118R-X206F/M/L/R/Y, X118R-X209W, X118R-X210II, X118R-X211P, X118R-X213A, X118R-X215K, X118R-X217K, X118R-X222Q, X118R-X249R, X118R-X261I, X118R-X262Q, X128L-X206F/L/M/R/Y, X128L-X209W, X128R-P210I, X128R-A215K, X128R-L217K, X128R-N261I, X129Q-X206F/L/M/R/Y, X129Q-X209W, X130A-X206F/L/M/R/Y, S130A-Y209W, X206L/Y-X213A, X206L/Y-X222Q, X206L/Y-X249R, X209W-X213A, X209W-X222Q, X209W-X249R, X210I-X217K, X210I-X261I, X213A-X222Q, X213A-X249R, X215K-X261I, X222Q-X249R, and combinations thereof, (iv) X3V-X76D-X118R, X18R-X24R-X206L/Y, X18R-X24R-X209W, X18R-X24R-X213A, X18R-X24R-X249R, X18R-X87D/R-X209W, X18R-X118R-X209W, X18R-X206L/Y-X209W, X18R-X206L/Y-X249R, X18R-X209W-X213A, X18R-X209W-X222Q, X18R-X209W-X249R, X18R-X213A-X249R, X24R-X76D-X78G/N, X24R-X76D-X87D/R. X24R-X76D-X118R, X24R-X76D-X209W, X24R-X76D-X222Q, X24R-X76D-X249R, X24R-X78G/N-X87D/R, X24R-X78G/N-X118R, X24R-X78G/N-X206L/Y, X24R-X78G/N-X209W, X24R-X78G/N-X222Q, X24R-X78G/N-X249R, X24R-X87D/R-X118R, X24R-X87D/R-X209W, X24R-X87D/R-X222Q, X24R-X87D/R-X249R, X24R-X118R-X209W, X24R-X118R-X222Q, X24R-X118R-X249R, X24R-X206L-X209W, X24R-X206L/Y-X249R, X24R-X209W-X213A, X24R-X209W-X222Q, X24R-X209W-X249R, X24R-X213A-X249R, X24R-X222Q-X249R, X76D-X78G/N-X87D/R, X76D-X78G/N-X118R, X76D-X78G/N-X129Q, X76D-X78G/N-X130A, X76D-X78G/N-X206L, X76D-X78G/N-X209W, X76D-X78G/N-X222Q, X76D-X78G/N-X249R, X76D-X87D/R-X118R, X76D-X87D/R-X206L/Y, X76D-X87D/R-X209W, X76D-X87D/R-X249R, X76D-X118R-X128R, X76D-X118R-X206L/Y, X76D-X118R-X209W, X76D-X118R-X222Q, X76D-X118R-X249R, X76D-X209W-X222Q, X76D-X209W-X249R, X78G/N-X87D/R-X118R, X78G/N-X87D/R-X129Q, X78G/N-X87D/R-X130A, X78G/N-X87D/R-X206L/Y, X78G/N-X87D/R-X209W, X78G/N-X87D/R-X222Q, X78G/N-X87D/R-X249R, X78G/N-X118R-X129Q, X78G/N-X118R-X209W, X78G/N-X118R-X222Q, X78G/N-X118R-X249R, X78G/N-X129Q-X130A, X78G/N-X209W-X222Q, X78G/N-X209W-X249R, X78G/N-X222Q-X249R, X87D/R-X118R-X206L, X87D/R-X118R-X209W, X87D/R-X118R-X249R, X87D/R-X206L/Y-X209W, X87D/R-X209W-X222Q, X87D/R-X209W-X249R, X87D/R-X222Q-X249R, X118R-X209W-X213A, X118R-X209W-X222Q, X118R-X209W-X249R, X118R-X222Q-X249R, X206L-X209W-X249R, X209W-X213A-X222Q, X209W-X213A-X249R, X209W-X222Q-X249R, and combinations thereof, (v) S3V-I8V, S3V-P40E, S3V-S78G/N, S3V-S87D, S3V-G118R, S3V-S128R, S3V-P129Q, S3V-S130A, S3V-P210I, S3V-G211P, S3V-A215K, S3V-L217K, S3V-N261I, S3V-L262Q, I8V-P40E, I8V-N76D, I8V-S87D, I8V-G118R, I8V-S128R, I8V-P210I, I8V-A215K, I8V-N261I, N18R-S78N, N18R-S87R, N18R-G118R, N18R-Q206L, S24R-S78N, S24R-S87D/R, S24R-Q206L/Y, S24R-Y209W, S24R-T213A, S24R-M222Q, P40E-N76D, P40E-S87D/R, P40E-G118R, P40E-S128R, P40E-P210I, P40E-A215K, P40E-L217K, P40E-N261I, N76D-S87D, N76D-P210I, N76D-S128R, N76D-Q206F/R/M/Y, N76D-P210I, N76D-G211P, N76D-T213A, N76D-A215K, N76D-L217K, N76D-H249R, N76D-N261I, N76D-L262Q, S78G-Q206F/L/M/Y, S78G-P210I, S78G-N261I, S78G/N-S87D/R, S78G/N-G118R, S78G/N-S128L, S78G/N-P129Q, S78G/N-S130A, S78N-T213A, S78N-M222Q, S78N-H249R, S87D-G118R, S87D-S128L/R, S87D-P129Q, S87D-S130A, S87D/R-Y209W, S87D-P210I, S87D-A215K, S87D-L217K, S87D/R-M222Q, S87D/R-H249R, S87R-Q206F/L/M/R/Y, S87R-T213A, S87D/R-N261I, G118R-S128R, G118R-Q206L/R/Y, G118R-Y209W, G118R-P210I, G118R-G211P, G118R-T213A, G118R-L217K, G118R-M222Q, G118R-H249R, G118R-N261I, G118R-L262Q, S128L-Q206F/L/M/R/Y, S128L-Y209W, S128R-P210I, S128R-A215K, S128R-L217K, S128R-N261I, P129Q-Q206F/L/M/R/Y, P129Q-Y209W, S130A-Q206F/L/M/R/Y, S130A-Y209W, Q206L/Y-T213A, Q206L/Y-M222Q, Q206L/Y-H249R, Y209W-T213A, Y209W-M222Q, Y209W-H249R, P210I-L217K, P210I-N261I, T213A-M222Q, T213A-H249R, A215K-N261I, M222Q-H249R, and combinations thereof, or (vi) S3V-N76D-G118R, N18R-S24R-Q206L/Y, N18R-S24R-Y209W, N18R-S24R-T213A, N18R-S24R-H249R, N18R-S87D/R-Y209W, N18R-G118R-Y209W, N18R-Q206L/Y-Y209W, N18R-Q206L/Y-H249R, N18R-Y209W-T213A, N18R-Y209W-M222Q, N18R-Y209W-H249R, N18R-T213A-H249R, S24R-N76D-S78G/N, S24R-N76D-S87D/R, S24R-N76D-G118R, S24R-N76D-Y209W, S24R-N76D-M222Q, S24R-N76D-H249R, S24R-S78G/N-S87D/R, S24R-S78G/N-G118R, S24R-S78G/N-Q206L, Y209W S24R-S78G/N-Y209W, S24R-S78G/N-M222Q, S24R-S78G/N-H249R, S24R-S87D/R-G118R, S24R-S87D/R-Y209W, S24R-S87D/R-M222Q, S24R-S87D/R-H249R, S24R-G118R-Y209W, S24R-G118R-M222Q, S24R-G118R-H249R, S24R-Q206L/Y-Y209W, S24R-Q206L/Y-H249R, S24R-Y209W-T213A, S24R-Y209W-M222Q, S24R-Y209W-H249R, S24R-T213A-H249R, S24R-M222Q-H249R, N76D-S78G/N-S87D/R, N76D-S78G/N-G118R, N76D-S78G/N-P129Q, N76D-S78G/N-S130A, N76D-S78G/N-Q206L, N76D-S78G/N-Y209W, N76D-S78G/N-M222Q, N76D-S78G/N-H249R, N76D-S87D/R-G118R, N76D-S87D/R-Q206L/Y, N76D-S87D/R-Y209W, N76D-S87D/R-H249R, N76D-G118R-S128R, N76D-G118R-Q206L/Y, N76D-G118R-Y209W, N76D-G118R-M222Q, N76D-G118R-H249R, N76D-Y209W-M222Q, N76D-Y209W-H249R, S78G/N-S87D/R-G118R, S78G/N-S87D/R-P129Q, S78G/N-S87D/R-S130A, S78G/N-S87D/R-Q206L/Y, S78G/N-S87D/R-Y209W, S78G/N-S87D/R-M222Q, S78G/N-S87D/R-H249R, S78G/N-G118R-P129Q, S78G/N-G118R-Y209W, S78G/N-G118R-M222Q, S78G/N-G118R-H249R, S78G/N-P129Q-S130A, S78G/N-Y209W-M222Q, S78G/N-Y209W-H249R, S78G/N-M222Q-H249R, S87D/R-G118R-Q206L, S87D/R-G118R-Y209W, S87D/R-G118R-H249R, S87D/R-Q206L/Y-Y209W, S87D/R-Y209W-H249R, S87D/R-Y209W-M222Q, S87D/R-M222Q-H249R, G118R-Y209W-T213A, G118R-Y209W-M222Q, G118R-Y209W-H249R, G118R-M222Q-H249R, Q206L/Y-Y209W-H249R, Y209W-T213A-M222Q, Y209W-T213A-H249R, Y209W-M222Q-H249R, and combinations thereof, and wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. Still another embodiment provides an isolated subtilisin variant comprising an amino acid sequence comprising two or more substitutions selected from: (i) 3-8, 3-40, 3-78, 3-87, 3-118, 3-128, 3-129, 3-130, 3-210, 3-211, 3-215, 3-217, 3-261, 3-262, 8-40, 8-76, 8-87, 8-118, 8-128, 8-210, 8-215, 8-261, 18-78, 18-87, 18-118, 18-206, 24-87, 24-206, 24-209, 24-213, 24-222, 40-76, 40-87, 40-118, 40-128, 40-210, 40-215, 40-217, 40-261, 76-210, 76-211, 76-213, 76-215, 76-217, 76-249, 76-261, 76-262, 78-87, 78-118, 78-210, 78-213, 78-222, 78-249, 87-206, 87-209, 87-213, 87-215, 87-217, 87-222, 87-249, 87-261, 118-206, 118-209, 118-210, 118-211, 118-213, 118-215, 118-217, 118-222, 118-249, 118-261, 118-262, 128-209, 128-210, 128-215, 128-217, 128-261, 129-206, 129-209, 130-206, 130-209, 206-213, 206-249, 209-213, 209-249, 210-217, 210-261, 213-222, 213-249, 215-261, 222-249, and combinations thereof, (ii) 3-76-118, 18-24-206, 18-24-209, 18-24-213, 18-24-249, 18-87-209, 18-118-209, 18-206-209, 18-209-213, 18-209-222, 18-209-249, 18-213-249, 24-76-78, 24-76-87, 24-76-118, 24-76-209, 24-76-222, 24-76-249, 24-78-87, 24-78-118, 24-78-206, 24-78-209, 24-78-222, 24-78-249, 24-87-118, 24-87-209, 24-87-222, 24-87-249, 24-118-209, 24-118-222, 24-118-249, 24-206-209, 24-206-249, 24-209-213, 24-209-222, 24-209-249, 24-213-249, 24-222-249, 76-78-118, 76-78-87, 76-78-129, 76-78-130, 76-78-206, 76-78-209, 76-78-222, 76-78-249, 76-87-118, 76-87-206, 76-87-209, 76-87-249, 76-118-128, 76-118-206, 76-118-209, 76-118-222, 76-118-249, 76-209-222, 76-209-249, 78-87-118, 78-87-129, 78-87-130, 78-87-206, 78-87-209, 78-87-222, 78-87-249, 78-118-129, 78-118-209, 78-118-222, 78-118-249, 78-129-130, 78-209-222, 78-209-249, 78-222-249, 87-118-206, 87-118-209, 87-118-249, 87-206-209, 87-209-222, 87-209-249, 87-222-249, 118-209-213, 118-209-222, 118-209-249, 118-222-249, 206-209-249, 209-213-222, 209-213-249, 209-222-249, and combinations thereof, (iii) X3V-X8V, X3V-X40E, X3V-X78G/N, X3V-X87D, X3V-X118R, X3V-X128R, X3V-X129Q, X3V-X130A, X3V-X210I, X3V-X211P, X3V-X215K, X3V-X217K, X3V-X261I, X3V-X262Q, X8V-X40E, X8V-X76D, X8V-X87D, X8V-X118R, X8V-X128R, X8V-X210I, X8V-X215K, X8V-X261I, X18R-X78N, X18R-X87R, X18R-X118R, X18R-X206L, X24R-S78N, X24R-X87D/R, X24R-X206L/Y, X24R-X209W, X24R-X213A, X24R-X222Q, X40E-X76D, X40E-X87D/R, X40E-X118R, X40E-X128R, X40E-X210I, X40E-X215K, X40E-X217K, X40E-X261I, X76D-X87D, X76D-X128R, X76D-X206F/R/M/Y, X76D-X210I, X76D-X211P, X76D-X213A, X76D-X215K, X76D-X217K, X76D-X249R, X76D-X261I, X76D-X262Q, X78G-X206F/L/MY, X78G-X210I, X78G-X261I, X78G/N-X87D/R, X78G/N-X118R, X78G/N-X128L, X78G/N-X129Q, X78G/N-X130A, X78N-X213A, X78N-X222Q, X78N-X249R, X87D-X118R, X87D-X128L/R, X87D-X129Q, X87D-X130A, X87D/R-X209W, X87D-X210I, X87D-X215K, X87D-X217K, X87D/R-X222Q, X87D/R-X249R, X87R-X206F/L/M/R/Y, X87R-X213A, X87D/R-X261I, X118R-X128R, X118R-X206F/M/L/R/Y, X118R-X209W, X118R-X210II, X118R-X211P, X118R-X213A, X118R-X215K, X118R-X217K, X118R-X222Q, X118R-X249R, X118R-X261I, X118R-X262Q, X128L-X206F/L/M/R/Y, X128L-X209W, X128R-P210I, X128R-A215K, X128R-L217K, X128R-N261I, X129Q-X206F/L/M/R/Y, X129Q-X209W, X130A-X206F/L/M/R/Y, S130A-Y209W, X206L/Y-X213A, X206L/Y-X222Q, X206L/Y-X249R, X209W-X213A, X209W-X222Q, X209W-X249R, X210I-X217K, X210I-X261I, X213A-X222Q, X213A-X249R, X215K-X261I, X222Q-X249R, and combinations thereof, (iv) X3V-X76D-X118R, X18R-X24R-X206L/Y, X18R-X24R-X209W, X18R-X24R-X213A, X18R-X24R-X249R, X18R-X87D/R-X209W, X18R-X118R-X209W, X18R-X206L/Y-X209W, X18R-X206L/Y-X249R, X18R-X209W-X213A, X18R-X209W-X222Q, X18R-X209W-X249R, X18R-X213A-X249R, X24R-X76D-X78G/N, X24R-X76D-X87D/R. X24R-X76D-X118R, X24R-X76D-X209W, X24R-X76D-X222Q, X24R-X76D-X249R, X24R-X78G/N-X87D/R, X24R-X78G/N-X118R, X24R-X78G/N-X206L/Y, X24R-X78G/N-X209W, X24R-X78G/N-X222Q, X24R-X78G/N-X249R, X24R-X87D/R-X118R, X24R-X87D/R-X209W, X24R-X87D/R-X222Q, X24R-X87D/R-X249R, X24R-X118R-X209W, X24R-X118R-X222Q, X24R-X118R-X249R, X24R-X206L-X209W, X24R-X206L/Y-X249R, X24R-X209W-X213A, X24R-X209W-X222Q, X24R-X209W-X249R, X24R-X213A-X249R, X24R-X222Q-X249R, X76D-X78G/N-X87D/R, X76D-X78G/N-X118R, X76D-X78G/N-X129Q, X76D-X78G/N-X130A, X76D-X78G/N-X206L, X76D-X78G/N-X209W, X76D-X78G/N-X222Q, X76D-X78G/N-X249R, X76D-X87D/R-X118R, X76D-X87D/R-X206L/Y, X76D-X87D/R-X209W, X76D-X87D/R-X249R, X76D-X118R-X128R, X76D-X118R-X206L/Y, X76D-X118R-X209W, X76D-X118R-X222Q, X76D-X118R-X249R, X76D-X209W-X222Q, X76D-X209W-X249R, X78G/N-X87D/R-X118R, X78G/N-X87D/R-X129Q, X78G/N-X87D/R-X130A, X78G/N-X87D/R-X206L/Y, X78G/N-X87D/R-X209W, X78G/N-X87D/R-X222Q, X78G/N-X87D/R-X249R, X78G/N-X118R-X129Q, X78G/N-X118R-X209W, X78G/N-X118R-X222Q, X78G/N-X118R-X249R, X78G/N-X129Q-X130A, X78G/N-X209W-X222Q, X78G/N-X209W-X249R, X78G/N-X222Q-X249R, X87D/R-X118R-X206L, X87D/R-X118R-X209W, X87D/R-X118R-X249R, X87D/R-X206L/Y-X209W, X87D/R-X209W-X222Q, X87D/R-X209W-X249R, X87D/R-X222Q-X249R, X118R-X209W-X213A, X118R-X209W-X222Q, X118R-X209W-X249R, X118R-X222Q-X249R, X206L-X209W-X249R, X209W-X213A-X222Q, X209W-X213A-X249R, X209W-X222Q-X249R, and combinations thereof, (v) S3V-I8V, S3V-P40E, S3V-S78G/N, S3V-S87D, S3V-G118R, S3V-S128R, S3V-P129Q, S3V-S130A, S3V-P210I, S3V-G211P, S3V-A215K, S3V-L217K, S3V-N261I, S3V-L262Q, I8V-P40E, I8V-N76D, I8V-S87D, I8V-G118R, I8V-S128R, I8V-P210I, I8V-A215K, I8V-N261I, N18R-S78N, N18R-S87R, N18R-G118R, N18R-Q206L, S24R-S78N, S24R-S87D/R, S24R-Q206L/Y, S24R-Y209W, S24R-T213A, S24R-M222Q, P40E-N76D, P40E-S87D/R, P40E-G118R, P40E-S128R, P40E-P210I, P40E-A215K, P40E-L217K, P40E-N261I, N76D-S87D, N76D-P210I, N76D-S128R, N76D-Q206F/R/M/Y, N76D-P210I, N76D-G211P, N76D-T213A, N76D-A215K, N76D-L217K, N76D-H249R, N76D-N261I, N76D-L262Q, S78G-Q206F/L/M/Y, S78G-P210I, S78G-N261I, S78G/N-S87D/R, S78G/N-G118R, S78G/N-S128L, S78G/N-P129Q, S78G/N-S130A, S78N-T213A, S78N-M222Q, S78N-H249R, S87D-G118R, S87D-S128L/R, S87D-P129Q, S87D-S130A, S87D/R-Y209W, S87D-P210I, S87D-A215K, S87D-L217K, S87D/R-M222Q, S87D/R-H249R, S87R-Q206F/L/M/R/Y, S87R-T213A, S87D/R-N261I, G118R-S128R, G118R-Q206L/R/Y, G118R-Y209W, G118R-P210I, G118R-G211P, G118R-T213A, G118R-L217K, G118R-M222Q, G118R-H249R, G118R-N261I, G118R-L262Q, S128L-Q206F/L/M/R/Y, S128L-Y209W, S128R-P210I, S128R-A215K, S128R-L217K, S128R-N261I, P129Q-Q206F/L/M/R/Y, P129Q-Y209W, S130A-Q206F/L/M/R/Y, S130A-Y209W, Q206L/Y-T213A, Q206L/Y-M222Q, Q206L/Y-H249R, Y209W-T213A, Y209W-M222Q, Y209W-H249R, P210I-L217K, P210I-N261I, T213A-M222Q, T213A-H249R, A215K-N261I, M222Q-H249R, and combinations thereof, or (vi) S3V-N76D-G118R, N18R-S24R-Q206L/Y, N18R-S24R-Y209W, N18R-S24R-T213A, N18R-S24R-H249R, N18R-S87D/R-Y209W, N18R-G118R-Y209W, N18R-Q206L/Y-Y209W, N18R-Q206L/Y-H249R, N18R-Y209W-T213A, N18R-Y209W-M222Q, N18R-Y209W-H249R, N18R-T213A-H249R, S24R-N76D-S78G/N, S24R-N76D-S87D/R, S24R-N76D-G118R, S24R-N76D-Y209W, S24R-N76D-M222Q, S24R-N76D-H249R, S24R-S78G/N-S87D/R, S24R-S78G/N-G118R, S24R-S78G/N-Q206L, Y209W S24R-S78G/N-Y209W, S24R-S78G/N-M222Q, S24R-S78G/N-H249R, S24R-S87D/R-G118R, S24R-S87D/R-Y209W, S24R-S87D/R-M222Q, S24R-S87D/R-H249R, S24R-G118R-Y209W, S24R-G118R-M222Q, S24R-G118R-H249R, S24R-Q206L/Y-Y209W, S24R-Q206L/Y-H249R, S24R-Y209W-T213A, S24R-Y209W-M222Q, S24R-Y209W-H249R, S24R-T213A-H249R, S24R-M222Q-H249R, N76D-S78G/N-S87D/R, N76D-S78G/N-G118R, N76D-S78G/N-P129Q, N76D-S78G/N-S130A, N76D-S78G/N-Q206L, N76D-S78G/N-Y209W, N76D-S78G/N-M222Q, N76D-S78G/N-H249R, N76D-S87D/R-G118R, N76D-S87D/R-Q206L/Y, N76D-S87D/R-Y209W, N76D-S87D/R-H249R, N76D-G118R-S128R, N76D-G118R-Q206L/Y, N76D-G118R-Y209W, N76D-G118R-M222Q, N76D-G118R-H249R, N76D-Y209W-M222Q, N76D-Y209W-H249R, S78G/N-S87D/R-G118R, S78G/N-S87D/R-P129Q, S78G/N-S87D/R-S130A, S78G/N-S87D/R-Q206L/Y, S78G/N-S87D/R-Y209W, S78G/N-S87D/R-M222Q, S78G/N-S87D/R-H249R, S78G/N-G118R-P129Q, S78G/N-G118R-Y209W, S78G/N-G118R-M222Q, S78G/N-G118R-H249R, S78G/N-P129Q-S130A, S78G/N-Y209W-M222Q, S78G/N-Y209W-H249R, S78G/N-M222Q-H249R, S87D/R-G118R-Q206L, S87D/R-G118R-Y209W, S87D/R-G118R-H249R, S87D/R-Q206L/Y-Y209W, S87D/R-Y209W-H249R, S87D/R-Y209W-M222Q, S87D/R-M222Q-H249R, G118R-Y209W-T213A, G118R-Y209W-M222Q, G118R-Y209W-H249R, G118R-M222Q-H249R, Q206L/Y-Y209W-H249R, Y209W-T213A-M222Q, Y209W-T213A-H249R, Y209W-M222Q-H249R, and combinations thereof, wherein said variant has proteolytic activity and the amino acid sequence of said variant further comprises one or more substitutions selected from: (i) 1, 3, 8, 9, 16, 20, 22, 28, 42, 43, 44, 56, 76, 77, 82, 88, 89, 99, 100, 101, 103, 104, 108, 116, 118, 120, 124, 127, 128, 147, 150, 158, 159, 160, 166, 185, 188, 194, 204, 210, 211, 212, 215, 216, 217, 218, 222, 232, 235, 241, 243, 245, 246, 248, 251, 252, 254, 256, 259, 261, 262, 268, 270, and 271; (ii) X1V, X3I/T/V, X8V, X9G, X16T, X20E/R, X22L/W, X28T, X42I, X43R/S/Y, X44V, X56P, X76D, X77D, X82D, X88S, X89H, X99N, X100S, X101F/G/H/Q/T/V, X103A/D/P, X104I, X108S, X116L/M, X118A/R/V, X120R, X124M, X127S/T, X128K/L/R, X147I, X150T, X158E/T/V, X159D, X160Q, X166D/N, X185Y, X188D, X194D/P, X204D, X210I/L, X211P, X212D, X215K/V, X216Y, X217K, X218S, X222L/Q/S, X232V, X235T, X241K, X243S, X245R, X246V, X248D, X251R, X252I, X254T, X256P, X259G, X261I/N, X262Q, X268A, X270P/T, and X271D; or (iii) A1V, S3I/T/V, I8V, S9G, A16T, G20E/R, T22L/W, V28T, L42I, N43R/S/Y, I44V, S56P, N76D, N77D, L82D, A88S, E89H, S99N, G100S, S101F/G/H/Q/T/V, S103A/D/P, V104I, A108S, N116L/M, G118A/R/V, H120R, L124M, G127S/T, S128K/LR, V147I, V150T, A158E/T/V, G159D, S160Q, S166D/N, N185Y, S188D, A194D/P, N204D, P210I/L, G211P, S212D, A215K/V, S216Y, L217K, N218S, M222L/Q/S, A232V, K235T, W241K, N243S, Q245R, I246V, N248D, K251R, N252I, A254T, S256P, S259G, N261I/N, L262Q, V268A, A270P/T, and E271D; and wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. Yet still another embodiment provides an isolated subtilisin variant comprising an amino acid sequence comprising two or more substitutions selected from: (i) 3-8, 3-40, 3-78, 3-87, 3-118, 3-128, 3-129, 3-130, 3-210, 3-211, 3-215, 3-217, 3-261, 3-262, 8-40, 8-76, 8-87, 8-118, 8-128, 8-210, 8-215, 8-261, 18-78, 18-87, 18-118, 18-206, 24-87, 24-206, 24-209, 24-213, 24-222, 40-76, 40-87, 40-118, 40-128, 40-210, 40-215, 40-217, 40-261, 76-210, 76-211, 76-213, 76-215, 76-217, 76-249, 76-261, 76-262, 78-87, 78-118, 78-210, 78-213, 78-222, 78-249, 87-206, 87-209, 87-213, 87-215, 87-217, 87-222, 87-249, 87-261, 118-206, 118-209, 118-210, 118-211, 118-213, 118-215, 118-217, 118-222, 118-249, 118-261, 118-262, 128-209, 128-210, 128-215, 128-217, 128-261, 129-206, 129-209, 130-206, 130-209, 206-213, 206-249, 209-213, 209-249, 210-217, 210-261, 213-222, 213-249, 215-261, 222-249, and combinations thereof, (ii) 3-76-118, 18-24-206, 18-24-209, 18-24-213, 18-24-249, 18-87-209, 18-118-209, 18-206-209, 18-209-213, 18-209-222, 18-209-249, 18-213-249, 24-76-78, 24-76-87, 24-76-118, 24-76-209, 24-76-222, 24-76-249, 24-78-87, 24-78-118, 24-78-206, 24-78-209, 24-78-222, 24-78-249, 24-87-118, 24-87-209, 24-87-222, 24-87-249, 24-118-209, 24-118-222, 24-118-249, 24-206-209, 24-206-249, 24-209-213, 24-209-222, 24-209-249, 24-213-249, 24-222-249, 76-78-118, 76-78-87, 76-78-129, 76-78-130, 76-78-206, 76-78-209, 76-78-222, 76-78-249, 76-87-118, 76-87-206, 76-87-209, 76-87-249, 76-118-128, 76-118-206, 76-118-209, 76-118-222, 76-118-249, 76-209-222, 76-209-249, 78-87-118, 78-87-129, 78-87-130, 78-87-206, 78-87-209, 78-87-222, 78-87-249, 78-118-129, 78-118-209, 78-118-222, 78-118-249, 78-129-130, 78-209-222, 78-209-249, 78-222-249, 87-118-206, 87-118-209, 87-118-249, 87-206-209, 87-209-222, 87-209-249, 87-222-249, 118-209-213, 118-209-222, 118-209-249, 118-222-249, 206-209-249, 209-213-222, 209-213-249, 209-222-249, and combinations thereof, (iii) X3V-X8V, X3V-X40E, X3V-X78G/N, X3V-X87D, X3V-X118R, X3V-X128R, X3V-X129Q, X3V-X130A, X3V-X210I, X3V-X211P, X3V-X215K, X3V-X217K, X3V-X261I, X3V-X262Q, X8V-X40E, X8V-X76D, X8V-X87D, X8V-X118R, X8V-X128R, X8V-X210I, X8V-X215K, X8V-X261I, X18R-X78N, X18R-X87R, X18R-X118R, X18R-X206L, X24R-S78N, X24R-X87D/R, X24R-X206L/Y, X24R-X209W, X24R-X213A, X24R-X222Q, X40E-X76D, X40E-X87D/R, X40E-X118R, X40E-X128R, X40E-X210I, X40E-X215K, X40E-X217K, X40E-X261I, X76D-X87D, X76D-X128R, X76D-X206F/R/M/Y, X76D-X210I, X76D-X211P, X76D-X213A, X76D-X215K, X76D-X217K, X76D-X249R, X76D-X261I, X76D-X262Q, X78G-X206F/L/M/Y, X78G-X210I, X78G-X261I, X78G/N-X87D/R, X78G/N-X118R, X78G/N-X128L, X78G/N-X129Q, X78G/N-X130A, X78N-X213A, X78N-X222Q, X78N-X249R, X87D-X118R, X87D-X128L/R, X87D-X129Q, X87D-X130A, X87D/R-X209W, X87D-X210I, X87D-X215K, X87D-X217K, X87D/R-X222Q, X87D/R-X249R, X87R-X206F/L/M/R/Y, X87R-X213A, X87D/R-X261I, X118R-X128R, X118R-X206F/M/L/R/Y, X118R-X209W, X118R-X210II, X118R-X211P, X118R-X213A, X118R-X215K, X118R-X217K, X118R-X222Q, X118R-X249R, X118R-X261I, X118R-X262Q, X128L-X206F/L/M/R/Y, X128L-X209W, X128R-P210I, X128R-A215K, X128R-L217K, X128R-N261I, X129Q-X206F/L/M/R/Y, X129Q-X209W, X130A-X206F/L/M/R/Y, S130A-Y209W, X206L/Y-X213A, X206L/Y-X222Q, X206L/Y-X249R, X209W-X213A, X209W-X222Q, X209W-X249R, X210I-X217K, X210I-X261I, X213A-X222Q, X213A-X249R, X215K-X261I, X222Q-X249R, and combinations thereof, (iv) X3V-X76D-X118R, X18R-X24R-X206L/Y, X18R-X24R-X209W, X18R-X24R-X213A, X18R-X24R-X249R, X18R-X87D/R-X209W, X18R-X118R-X209W, X18R-X206L/Y-X209W, X18R-X206L/Y-X249R, X18R-X209W-X213A, X18R-X209W-X222Q, X18R-X209W-X249R, X18R-X213A-X249R, X24R-X76D-X78G/N, X24R-X76D-X87D/R, X24R-X76D-X118R, X24R-X76D-X209W, X24R-X76D-X222Q, X24R-X76D-X249R, X24R-X78G/N-X87D/R, X24R-X78G/N-X118R, X24R-X78G/N-X206L/Y, X24R-X78G/N-X209W, X24R-X78G/N-X222Q, X24R-X78G/N-X249R, X24R-X87D/R-X118R, X24R-X87D/R-X209W, X24R-X87D/R-X222Q, X24R-X87D/R-X249R, X24R-X118R-X209W, X24R-X118R-X222Q, X24R-X118R-X249R, X24R-X206L/Y-X249R, X24R-X209W-X213A, X24R-X209W-X222Q, X24R-X209W-X249R, X24R-X213A-X249R, X24R-X222Q-X249R, X76D-X78G/N-X87D/R, X76D-X78G/N-X118R, X76D-X78G/N-X129Q, X76D-X78G/N-X130A, X76D-X78G/N-X206L, X76D-X78G/N-X209W, X76D-X78G/N-X222Q, X76D-X78G/N-X249R, X76D-X87D/R-X118R, X76D-X87D/R-X206L/Y, X76D-X87D/R-X209W, X76D-X87D/R-X249R, X76D-X118R-X128R, X76D-X118R-X206L/Y, X76D-X118R-X209W, X76D-X118R-X222Q, X76D-X118R-X249R, X76D-X209W-X222Q, X76D-X209W-X249R, X78G/N-X87D/R-X118R, X78G/N-X87D/R-X129Q, X78G/N-X87D/R-X130A, X78G/N-X87D/R-X206L/Y, X78G/N-X87D/R-X209W, X78G/N-X87D/R-X222Q, X78G/N-X87D/R-X249R, X78G/N-X118R-X129Q, X78G/N-X118R-X209W, X78G/N-X118R-X222Q, X78G/N-X118R-X249R, X78G/N-X129Q-X130A, X78G/N-X209W-X222Q, X78G/N-X209W-X249R, X78G/N-X222Q-X249R, X87D/R-X118R-X206L, X87D/R-X118R-X209W, X87D/R-X118R-X249R, X87D/R-X206L/Y-X209W, X87D/R-X209W-X222Q, X87D/R-X209W-X249R, X87D/R-X222Q-X249R, X118R-X209W-X213A, X118R-X209W-X222Q, X118R-X209W-X249R, X118R-X222Q-X249R, X206L-X209W-X249R, X209W-X213A-X222Q, X209W-X213A-X249R, X209W-X222Q-X249R, and combinations thereof, (v) S3V-I8V, S3V-P40E, S3V-S78G/N, S3V-S87D, S3V-G118R, S3V-S128R, S3V-P129Q, S3V-S130A, S3V-P210I, S3V-G211P, S3V-A215K, S3V-L217K, S3V-N261I, S3V-L262Q, I8V-P40E, I8V-N76D, I8V-S87D, I8V-G118R, I8V-S128R, I8V-P210I, I8V-A215K, I8V-N261I, N18R-S78N, N18R-S87R, N18R-G118R, N18R-Q206L, S24R-S78N, S24R-S87D/R, S24R-Q206L/Y, S24R-Y209W, S24R-T213A, S24R-M222Q, P40E-N76D, P40E-S87D/R, P40E-G118R, P40E-S128R, P40E-P210I, P40E-A215K, P40E-L217K, P40E-N261I, N76D-S87D, N76D-P210I, N76D-S128R, N76D-Q206F/R/M/Y, N76D-P210I, N76D-G211P, N76D-T213A, N76D-A215K, N76D-L217K, N76D-H249R, N76D-N261I, N76D-L262Q, S78G-Q206F/L/M/Y, S78G-P210I, S78G-N261I, S78G/N-S87D/R, S78G/N-G118R, S78G/N-S128L, S78G/N-P129Q, S78G/N-S130A, S78N-T213A, S78N-M222Q, S78N-H249R, S87D-G118R, S87D-S128L/R, S87D-P129Q, S87D-S130A, S87D/R-Y209W, S87D-P210I, S87D-A215K, S87D-L217K, S87D/R-M222Q, S87D/R-H249R, S87R-Q206F/L/M/R/Y, S87D/R-T213A, S87D/R-N261I, G118R-S128R, G118R-Q206L/R/Y, G118R-Y209W, G118R-P210I, G118R-G211P, G118R-T213A, G118R-L217K, G118R-M222Q, G118R-H249R, G118R-N261I, G118R-L262Q, S128L-Q206F/L/M/R/Y, S128L-Y209W, S128R-P210I, S128R-A215K, S128R-L217K, S128R-N261I, P129Q-Q206F/L/M/R/Y, P129Q-Y209W, S130A-Q206F/L/M/R/Y, S130A-Y209W, Q206L/Y-T213A, Q206L/Y-M222Q, Q206L/Y-H249R, Y209W-T213A, Y209W-M222Q, Y209W-H249R, P210I-L217K, P210I-N261I, T213A-M222Q, T213A-H249R, A215K-N261I, M222Q-H249R, and combinations thereof, or (vi) S3V-N76D-G118R, N18R-S24R-Q206L/Y, N18R-S24R-Y209W, N18R-S24R-T213A, N18R-S24R-H249R, N18R-S87D/R-Y209W, N18R-G118R-Y209W, N18R-Q206L/Y-Y209W, N18R-Q206L/Y-H249R, N18R-Y209W-T213A, N18R-Y209W-M222Q, N18R-Y209W-H249R, N18R-T213A-H249R, S24R-N76D-S78G/N, S24R-N76D-S87D/R, S24R-N76D-G118R, S24R-N76D-Y209W, S24R-N76D-M222Q, S24R-N76D-H249R, S24R-S78G/N-S87D/R, S24R-S78G/N-G118R, S24R-S78G/N-Q206L, Y209W S24R-S78G/N-

Y209W, S24R-S78G/N-M222Q, S24R-S78G/N-H249R, S24R-S87D/R-G118R, S24R-S87D/R-Y209W, S24R-S87D/R-M222Q, S24R-S87D/R-H249R, S24R-G118R-Y209W, S24R-G118R-M222Q, S24R-G118R-H249R, S24R-Q206L/Y-Y209W, S24R-Q206L/Y-H249R, S24R-Y209W-T213A, S24R-Y209W-M222Q, S24R-Y209W-H249R, S24R-T213A-H249R, S24R-M222Q-H249R, N76D-S78G/N-S87D/R, N76D-S78G/N-G118R, N76D-S78G/N-P129Q, N76D-S78G/N-S130A, N76D-S78G/N-Q206L, N76D-S78G/N-Y209W, N76D-S78G/N-M222Q, N76D-S78G/N-H249R, N76D-S87D/R-G118R, N76D-S87D/R-Q206L/Y, N76D-S87D/R-Y209W, N76D-S87D/R-H249R, N76D-G118R-S128R, N76D-G118R-Q206L/Y, N76D-G118R-Y209W, N76D-G118R-M222Q, N76D-G118R-H249R, N76D-Y209W-M222Q, N76D-Y209W-H249R, S78G/N-S87D/R-G118R, S78G/N-S87D/R-P129Q, S78G/N-S87D/R-S130A, S78G/N-S87D/R-Q206L/Y, S78G/N-S87D/R-Y209W, S78G/N-S87D/R-M222Q, S78G/N-S87D/R-H249R, S78G/N-G118R-P129Q, S78G/N-G118R-Y209W, S78G/N-G118R-M222Q, S78G/N-G118R-H249R, S78G/N-P129Q-S130A, S78G/N-Y209W-M222Q, S78G/N-Y209W-H249R, S78G/N-M222Q-H249R, S87D/R-G118R-Q206L, S87D/R-G118R-Y209W, S87D/R-G118R-H249R, S87D/R-Q206L/Y-Y209W, S87D/R-Y209W-H249R, S87D/R-Y209W-M222Q, S87D/R-M222Q-H249R, G118R-Y209W-T213A, G118R-Y209W-M222Q, G118R-Y209W-H249R, G118R-M222Q-H249R, Q206L/Y-Y209W-H249R, Y209W-T213A-M222Q, Y209W-T213A-H249R, Y209W-M222Q-H249R, and combinations thereof, wherein said variant has proteolytic activity and the amino acid sequence of said variant further comprises one or more substitutions selected from: (i) 3, 8, 22, 28, 43, 76, 89, 99, 101, 103, 104, 108, 116, 118, 124, 127, 128, 147, 150, 158, 159, 166, 188, 194, 210, 211, 212, 215, 217, 222, 232, 235, 243, 245, 246, 261, 262, 270, and 271; (ii) X3T/V, X8V, X22W, X28T, X43S, X76D, X89H, X99N, X101F/G/V, X103A/D/P, X104I, X108S, X116M, X118R, X124M, X127T, X128L, X147I, X150T, X158E/T, X159D, X166D, X188D, X194D/P, X210I/L, X211P, X212D, X215V, X217K, X222Q/S, X232V, X235T, X243S, X245R, X246V, X261I, X262Q, X270T, and X271D; or (iii) S3T/V, I8V, T22W, V28T, N43S, N76D, E89H, S99N, S101F/G/V, S103A/D/P, V104I, A108S, NI16M, GI18R, L124M, G127T, S128L, V147I, V150T, A158E/T, G159D, S166D, S188D, A194D/P, P210I/L, G211P, S212D, A215V, L217K, M222Q/S, A232V, K235T, N243S, Q245R, I246V, N261I, L262Q, A270T, and E271D; and wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. A further embodiment provides an isolated subtilisin variant comprising an amino acid sequence comprising two or more substitutions selected from: (i) 3-8, 3-40, 3-78, 3-87, 3-118, 3-128, 3-129, 3-130, 3-210, 3-211, 3-215, 3-217, 3-261, 3-262, 8-40, 8-76, 8-87, 8-118, 8-128, 8-210, 8-215, 8-261, 18-78, 18-87, 18-118, 18-206, 24-87, 24-206, 24-209, 24-213, 24-222, 40-76, 40-87, 40-118, 40-128, 40-210, 40-215, 40-217, 40-261, 76-210, 76-211, 76-213, 76-215, 76-217, 76-249, 76-261, 76-262, 78-87, 78-118, 78-210, 78-213, 78-222, 78-249, 87-206, 87-209, 87-213, 87-215, 87-217, 87-222, 87-249, 87-261, 118-206, 118-209, 118-210, 118-211, 118-213, 118-215, 118-217, 118-222, 118-249, 118-261, 118-262, 128-209, 128-210, 128-215, 128-217, 128-261, 129-206, 129-209, 130-206, 130-209, 206-213, 206-249, 209-213, 209-249, 210-217, 210-261, 213-222, 213-249, 215-261, 222-249, and combinations thereof, (ii) 3-76-118, 18-24-206, 18-24-209, 18-24-213, 18-24-249, 18-87-209, 18-118-209, 18-206-209, 18-209-213, 18-209-222, 18-209-249, 18-213-249, 24-76-78, 24-76-87, 24-76-118, 24-76-209, 24-76-222, 24-76-249, 24-78-87, 24-78-118, 24-78-206, 24-78-209, 24-78-222, 24-78-249, 24-87-118, 24-87-209, 24-87-222, 24-87-249, 24-118-209, 24-118-222, 24-118-249, 24-206-209, 24-206-249, 24-209-213, 24-209-222, 24-209-249, 24-213-249, 24-222-249, 76-78-118, 76-78-87, 76-78-129, 76-78-130, 76-78-206, 76-78-209, 76-78-222, 76-78-249, 76-87-118, 76-87-206, 76-87-209, 76-87-249, 76-118-128, 76-118-206, 76-118-209, 76-118-222, 76-118-249, 76-209-222, 76-209-249, 78-87-118, 78-87-129, 78-87-130, 78-87-206, 78-87-209, 78-87-222, 78-87-249, 78-118-129, 78-118-209, 78-118-222, 78-118-249, 78-129-130, 78-209-222, 78-209-249, 78-222-249, 87-118-206, 87-118-209, 87-118-249, 87-206-209, 87-209-222, 87-209-249, 87-222-249, 118-209-213, 118-209-222, 118-209-249, 118-222-249, 206-209-249, 209-213-222, 209-213-249, 209-222-249, and combinations thereof, (iii) X3V-X8V, X3V-X40E, X3V-X78G/N, X3V-X87D, X3V-X118R, X3V-X128R, X3V-X129Q, X3V-X130A, X3V-X210I, X3V-X211P, X3V-X215K, X3V-X217K, X3V-X261I, X3V-X262Q, X8V-X40E, X8V-X76D, X8V-X87D, X8V-X118R, X8V-X128R, X8V-X210I, X8V-X215K, X8V-X261I, X18R-X78N, X18R-X87R, X18R-X118R, X18R-X206L, X24R-S78N, X24R-X87D/R, X24R-X206L/Y, X24R-X209W, X24R-X213A, X24R-X222Q, X40E-X76D, X40E-X87D/R, X40E-X118R, X40E-X128R, X40E-X210I, X40E-X215K, X40E-X217K, X40E-X261I, X76D-X87D, X76D-X128R, X76D-X206F/R/M/Y, X76D-X210I, X76D-X211P, X76D-X213A, X76D-X215K, X76D-X217K, X76D-X249R, X76D-X261I, X76D-X262Q, X78G-X206F/L/M/Y, X78G-X210I, X78G-X261I, X78G/N-X87D/R, X78G/N-X118R, X78G/N-X128L, X78G/N-X129Q, X78G/N-X130A, X78N-X213A, X78N-X222Q, X78N-X249R, X87D-X118R, X87D-X128L/R, X87D-X129Q, X87D-X130A, X87D/R-X209W, X87D-X210I, X87D-X215K, X87D-X217K, X87D/R-X222Q, X87D/R-X249R, X87R-X206F/L/M/R/Y, X87R-X213A, X87D/R-X261I, X118R-X128R, X118R-X206F/M/L/R/Y, X118R-X209W, X118R-X210II, X118R-X211P, X118R-X213A, X118R-X215K, X118R-X217K, X118R-X222Q, X118R-X249R, X118R-X261I, X118R-X262Q, X128L-X206F/L/M/R/Y, X128L-X209W, X128R-P210I, X128R-A215K, X128R-L217K, X128R-N261I, X129Q-X206F/L/M/R/Y, X129Q-X209W, X130A-X206F/L/M/R/Y, S130A-Y209W, X206L/Y-X213A, X206L/Y-X222Q, X206L/Y-X249R, X209W-X213A, X209W-X222Q, X209W-X249R, X210I-X217K, X210I-X261I, X213A-X222Q, X213A-X249R, X215K-X261I, X222Q-X249R, and combinations thereof, (iv) X3V-X76D-X118R, X18R-X24R-X206L/Y, X18R-X24R-X209W, X18R-X24R-X213A, X18R-X24R-X249R, X18R-X87D/R-X209W, X18R-X118R-X209W, X18R-X206L/Y-X209W, X18R-X206L/Y-X249R, X18R-X209W-X213A, X18R-X209W-X222Q, X18R-X209W-X249R, X18R-X213A-X249R, X24R-X76D-X78G/N, X24R-X76D-X87D/R. X24R-X76D-X118R, X24R-X76D-X209W, X24R-X76D-X222Q, X24R-X76D-X249R, X24R-X78G/N-X87D/R, X24R-X78G/N-X118R, X24R-X78G/N-X206L/Y, X24R-X78G/N-X209W, X24R-X78G/N-X222Q, X24R-X78G/N-X249R, X24R-X87D/R-X118R, X24R-X87D/R-X209W, X24R-X87D/R-X222Q, X24R-X87D/R-X249R, X24R-X118R-X209W, X24R-X118R-X222Q, X24R-X118R-X249R, X24R-X206L-X209W, X24R-X206L/Y-X249R, X24R-X209W-X213A, X24R-X209W-X222Q, X24R-

X209W-X249R, X24R-X213A-X249R, X24R-X222Q-X249R, X76D-X78G/N-X87D/R, X76D-X78G/N-X118R, X76D-X78G/N-X129Q, X76D-X78G/N-X130A, X76D-X78G/N-X206L, X76D-X78G/N-X209W, X76D-X78G/N-X222Q, X76D-X78G/N-X249R, X76D-X87D/R-X118R, X76D-X87D/R-X206L/Y, X76D-X87D/R-X209W, X76D-X87D/R-X249R, X76D-X118R-X128R, X76D-X118R-X206L/Y, X76D-X118R-X209W, X76D-X118R-X222Q, X76D-X118R-X249R, X76D-X209W-X222Q, X76D-X209W-X249R, X78G/N-X87D/R-X118R, X78G/N-X87D/R-X129Q, X78G/N-X87D/R-X130A, X78G/N-X87D/R-X206L/Y, X78G/N-X87D/R-X209W, X78G/N-X87D/R-X222Q, X78G/N-X87D/R-X249R, X78G/N-X118R-X129Q, X78G/N-X118R-X209W, X78G/N-X118R-X222Q, X78G/N-X118R-X249R, X78G/N-X129Q-X130A, X78G/N-X209W-X222Q, X78G/N-X209W-X249R, X78G/N-X222Q-X249R, X87D/R-X118R-X206L, X87D/R-X118R-X209W, X87D/R-X118R-X249R, X87D/R-X206L/Y-X209W, X87D/R-X209W-X222Q, X87D/R-X209W-X249R, X87D/R-X222Q-X249R, X118R-X209W-X213A, X118R-X209W-X222Q, X118R-X209W-X249R, X118R-X222Q-X249R, X206L-X209W-X249R, X209W-X213A-X222Q, X209W-X213A-X249R, X209W-X249R, and combinations thereof, (v) S3V-I8V, S3V-P40E, S3V-S78G/N, S3V-S87D, S3V-G118R, S3V-S128R, S3V-P129Q, S3V-S130A, S3V-P210I, S3V-G211P, S3V-A215K, S3V-L217K, S3V-N261I, S3V-L262Q, I8V-P40E, I8V-N76D, I8V-S87D, I8V-G118R, I8V-S128R, I8V-P210I, I8V-A215K, I8V-N261I, N18R-S78N, N18R-S87R, N18R-G118R, N18R-Q206L, S24R-S78N, S24R-S87D/R, S24R-Q206L/Y, S24R-Y209W, S24R-T213A, S24R-M222Q, P40E-N76D, P40E-S87D/R, P40E-G118R, P40E-S128R, P40E-P210I, P40E-A215K, P40E-L217K, P40E-N261I, N76D-S87D, N76D-P210I, N76D-S128R, N76D-Q206F/R/M/Y, N76D-P210I, N76D-G211P, N76D-T213A, N76D-A215K, N76D-L217K, N76D-H249R, N76D-N261I, N76D-L262Q, S78G-Q206F/L/M/Y, S78G-P210I, S78G-N261I, S78G/N-S87D/R, S78G/N-G118R, S78G/N-S128L, S78G/N-P129Q, S78G/N-S130A, S78N-T213A, S78N-M222Q, S78N-H249R, S87D-G118R, S87D-S128L/R, S87D-P129Q, S87D-S130A, S87D/R-Y209W, S87D-P210I, S87D-A215K, S87D-L217K, S87D/R-M222Q, S87D/R-H249R, S87R-Q206F/L/M/R/Y, S87R-T213A, S87D/R-N261I, G118R-S128R, G118R-Q206L/R/Y, G118R-Y209W, G118R-P210I, G118R-G211P, G118R-T213A, G118R-L217K, G118R-M222Q, G118R-H249R, G118R-N261I, G118R-L262Q, S128L-Q206F/L/M/R/Y, S128L-Y209W, S128R-P210I, S128R-A215K, S128R-L217K, S128R-N261I, P129Q-Q206F/L/M/R/Y, P129Q-Y209W, S130A-Q206F/L/M/R/Y, S130A-Y209W, Q206L/Y-T213A, Q206L/Y-M222Q, Q206L/Y-H249R, Y209W-T213A, Y209W-M222Q, Y209W-H249R, P210I-L217K, P210I-N261I, T213A-M222Q, T213A-H249R, A215K-N261I, M222Q-H249R, and combinations thereof, or (vi) S3V-N76D-G118R, N18R-S24R-Q206L/Y, N18R-S24R-Y209W, N18R-S24R-T213A, N18R-S24R-H249R, N18R-S87D/R-Y209W, N18R-G118R-Y209W, N18R-Q206L/Y-Y209W, N18R-Q206L/Y-H249R, N18R-Y209W-T213A, N18R-Y209W-M222Q, N18R-Y209W-H249R, N18R-T213A-H249R, S24R-N76D-S78G/N, S24R-N76D-S87D/R, S24R-N76D-G118R, S24R-N76D-Y209W, S24R-N76D-M222Q, S24R-N76D-H249R, S24R-S78G/N-S87D/R, S24R-S78G/N-G118R, S24R-S78G/N-Q206L, Y209W S24R-S78G/N-Y209W, S24R-S78G/N-M222Q, S24R-S78G/N-H249R, S24R-S87D/R-G118R, S24R-S87D/R-Y209W, S24R-S87D/R-M222Q, S24R-S87D/R-H249R, S24R-G118R-Y209W, S24R-G118R-M222Q, S24R-G118R-H249R, S24R-Q206L/Y-Y209W, S24R-Q206L/Y-H249R, S24R-Y209W-T213A, S24R-Y209W-M222Q, S24R-Y209W-H249R, S24R-T213A-H249R, S24R-M222Q-H249R, N76D-S78G/N-S87D/R, N76D-S78G/N-G118R, N76D-S78G/N-P129Q, N76D-S78G/N-S130A, N76D-S78G/N-Q206L, N76D-S78G/N-Y209W, N76D-S78G/N-M222Q, N76D-S78G/N-H249R, N76D-S87D/R-G118R, N76D-S87D/R-Q206L/Y, N76D-S87D/R-Y209W, N76D-S87D/R-H249R, N76D-G118R-S128R, N76D-G118R-Q206L/Y, N76D-G118R-Y209W, N76D-G118R-M222Q, N76D-G118R-H249R, N76D-Y209W-M222Q, N76D-Y209W-H249R, S78G/N-S87D/R-G118R, S78G/N-S87D/R-P129Q, S78G/N-S87D/R-S130A, S78G/N-S87D/R-Q206L/Y, S78G/N-S87D/R-Y209W, S78G/N-S87D/R-M222Q, S78G/N-S87D/R-H249R, S78G/N-G118R-P129Q, S78G/N-G118R-Y209W, S78G/N-G118R-M222Q, S78G/N-G118R-H249R, S78G/N-P129Q-S130A, S78G/N-Y209W-M222Q, S78G/N-Y209W-H249R, S78G/N-M222Q-H249R, S87D/R-G118R-Q206L, S87D/R-G118R-Y209W, S87D/R-G118R-H249R, S87D/R-Q206L/Y-Y209W, S87D/R-Y209W-H249R, S87D/R-Y209W-M222Q, S87D/R-M222Q-H249R, G118R-Y209W-T213A, G118R-Y209W-M222Q, G118R-Y209W-H249R, G118R-M222Q-H249R, Q206L/Y-Y209W-H249R, Y209W-T213A-M222Q, Y209W-T213A-H249R, Y209W-M222Q-H249R, and combinations thereof, wherein said variant has proteolytic activity and the amino acid sequence of said variant further comprises one or more substitutions selected from: (i) 1, 3, 8, 9, 16, 20, 22, 28, 42, 43, 44, 56, 76, 77, 82, 88, 100, 101, 103, 104, 108, 116, 118, 120, 124, 127, 128, 147, 150, 158, 159, 160, 166, 185, 194, 204, 210, 211, 212, 215, 216, 217, 218, 222, 232, 241, 245, 248, 251, 252, 254, 256, 259, 261, 262, 268, 270, 271; (ii) X1V, X3I/V, X8V, X9G, X16T, X20E/R, X22L/W, X28T, X42I, X43R/Y, X44V, X56P, X76D, X77D, X82D, X88S, X100S, X101G/H/Q/T/V, X103A, X104I, X108S, X116L/M, X118A/R/V, X120R, X124M, X127S/T, X128K/L/R, X147I, X150T, X158E/V, X160Q, X166D/N, X185Y, X194D/P, X204D, X210I, X211P, X212D, X215K/V, X216Y, X217K, X218S, X222Q/S, X232V, X241K, X245R, X248D, X251R, X252I, X254T, X256P, X259G, X261I, X262Q, X268A, X270P, and X271D; or (iii) A1V, S3I/V, 18V, S9G, A16T, G20E/R, T22L/W, V28T, L42I, N43R/Y, I44V, S56P, N76D, N77D, L82D, A88S, G100S, S101G/H/Q/T/V, S103A, V104I, A108S, N116L/M, G118A/R/V, H120R, L124M, G127S/T, S128K/LR, V147I, V150T, A158E/V, S160Q, S166D/N, N185Y, A194D/P, N204D, P210I, G211P, S212D, A215K/V, S216Y, L217K, N218S, M222Q/S, A232V, W241K, Q245R, N248D, K251R, N252I, A254T, S256P, S259G, N261I, L262Q, V268A, A270P, and E271D; and wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. A yet further embodiment provides an isolated subtilisin variant comprising an amino acid sequence comprising two or more substitutions selected from: (i) 3-8, 3-40, 3-78, 3-87, 3-118, 3-128, 3-129, 3-130, 3-210, 3-211, 3-215, 3-217, 3-261, 3-262, 8-40, 8-76, 8-87, 8-118, 8-128, 8-210, 8-215, 8-261, 18-78, 18-87,18-118, 18-206, 24-87, 24-206, 24-209, 24-213, 24-222, 40-76, 40-87, 40-118, 40-128, 40-210, 40-215, 40-217, 40-261, 76-210, 76-211, 76-213, 76-215, 76-217, 76-249, 76-261, 76-262, 78-87, 78-118, 78-210, 78-213, 78-222, 78-249, 87-206, 87-209, 87-213, 87-215, 87-217, 87-222, 87-249, 87-261, 118-206, 118-209, 118-210, 118-211, 118-213, 118-215, 118-217, 118-222, 118-

249, 118-261, 118-262, 128-209, 128-210, 128-215, 128-217, 128-261, 129-206, 129-209, 130-206, 130-209, 206-213, 206-249, 209-213, 209-249, 210-217, 210-261, 213-222, 213-249, 215-261, 222-249, and combinations thereof, (ii) 3-76-118, 18-24-206, 18-24-209, 18-24-213, 18-24-249, 18-87-209, 18-118-209, 18-206-209, 18-209-213, 18-209-222, 18-209-249, 18-213-249, 24-76-78, 24-76-87, 24-76-118, 24-76-209, 24-76-222, 24-76-249, 24-78-87, 24-78-118, 24-78-206, 24-78-209, 24-78-222, 24-78-249, 24-87-118, 24-87-209, 24-87-222, 24-87-249, 24-118-209, 24-118-222, 24-118-249, 24-206-209, 24-206-249, 24-209-213, 24-209-222, 24-209-249, 24-213-249, 24-222-249, 76-78-118, 76-78-87, 76-78-129, 76-78-130, 76-78-206, 76-78-209, 76-78-222, 76-78-249, 76-87-118, 76-87-206, 76-87-209, 76-87-249, 76-118-128, 76-118-206, 76-118-209, 76-118-222, 76-118-249, 76-209-222, 76-209-249, 78-87-118, 78-87-129, 78-87-130, 78-87-206, 78-87-209, 78-87-222, 78-87-249, 78-118-129, 78-118-209, 78-118-222, 78-118-249, 78-129-130, 78-209-222, 78-209-249, 78-222-249, 87-118-206, 87-118-209, 87-118-249, 87-206-209, 87-209-222, 87-209-249, 87-222-249, 118-209-213, 118-209-222, 118-209-249, 118-222-249, 206-209-249, 209-213-222, 209-213-249, 209-222-249, and combinations thereof, (iii) X3V-X8V, X3V-X40E, X3V-X78G/N, X3V-X87D, X3V-X118R, X3V-X128R, X3V-X129Q, X3V-X130A, X3V-X210I, X3V-X211P, X3V-X215K, X3V-X217K, X3V-X261I, X3V-X262Q, X8V-X40E, X8V-X76D, X8V-X87D, X8V-X118R, X8V-X128R, X8V-X210I, X8V-X215K, X8V-X261I, X18R-X78N, X18R-X87R, X18R-X118R, X18R-X206L, X24R-S78N, X24R-X87D/R, X24R-X206L/Y, X24R-X209W, X24R-X213A, X24R-X222Q, X40E-X76D, X40E-X87D/R, X40E-X118R, X40E-X128R, X40E-X210I, X40E-X215K, X40E-X217K, X40E-X261I, X76D-X87D, X76D-X128R, X76D-X206F/R/M/Y, X76D-X210I, X76D-X211P, X76D-X213A, X76D-X215K, X76D-X217K, X76D-X249R, X76D-X261I, X76D-X262Q, X78G-X206F/L/M/Y, X78G-X210I, X78G-X261I, X78G/N-X87D/R, X78G/N-X118R, X78G/N-X128L, X78G/N-X129Q, X78G/N-X130A, X78N-X213A, X78N-X222Q, X78N-X249R, X87D-X118R, X87D-X128L/R, X87D-X129Q, X87D-X130A, X87D/R-X209W, X87D-X210I, X87D-X215K, X87D-X217K, X87D/R-X222Q, X87D/R-X249R, X87R-X206F/L/M/R/Y, X87R-X213A, X87D/R-X261I, X118R-X128R, X118R-X206F/M/L/R/Y, X118R-X209W, X118R-X210II, X118R-X211P, X118R-X213A, X118R-X215K, X118R-X217K, X118R-X222Q, X118R-X249R, X118R-X261I, X118R-X262Q, X128L-X206F/L/M/R/Y, X128L-X209W, X128L-P210I, X128R-A215K, X128R-L217K, X128R-N261I, X129Q-X206F/L/M/R/Y, X129Q-X209W, X130A-X206F/L/M/R/Y, S130A-Y209W, X206L/Y-X213A, X206L/Y-X222Q, X206L/Y-X249R, X209W-X213A, X209W-X222Q, X209W-X249R, X210I-X217K, X210I-X261I, X213A-X222Q, X213A-X249R, X215K-X261I, X222Q-X249R, and combinations thereof, (iv) X3V-X76D-X118R, X18R-X24R-X206L/Y, X18R-X24R-X209W, X18R-X24R-X213A, X18R-X24R-X249R, X18R-X87D/R-X209W, X18R-X118R-X209W, X18R-X206L/Y-X209W, X18R-X206L/Y-X249R, X18R-X209W-X213A, X18R-X209W-X222Q, X18R-X209W-X249R, X18R-X213A-X249R, X24R-X76D-X78G/N, X24R-X76D-X87D/R, X24R-X76D-X118R, X24R-X76D-X209W, X24R-X76D-X222Q, X24R-X76D-X249R, X24R-X78G/N-X87D/R, X24R-X78G/N-X118R, X24R-X78G/N-X206L/Y, X24R-X78G/N-X209W, X24R-X78G/N-X222Q, X24R-X78G/N-X249R, X24R-X87D/R-X118R, X24R-X87D/R-X209W, X24R-X87D/R-X222Q, X24R-X87D/R-X249R, X24R-X118R-X209W, X24R-X118R-X222Q, X24R-X118R-X249R, X24R-X206L-X209W, X24R-X206L/Y-X249R, X24R-X209W-X213A, X24R-X209W-X222Q, X24R-X209W-X249R, X24R-X213A-X249R, X24R-X222Q-X249R, X76D-X78G/N-X87D/R, X76D-X78G/N-X118R, X76D-X78G/N-X129Q, X76D-X78G/N-X130A, X76D-X78G/N-X206L, X76D-X78G/N-X209W, X76D-X78G/N-X222Q, X76D-X78G/N-X249R, X76D-X87D/R-X118R, X76D-X87D/R-X206L/Y, X76D-X87D/R-X209W, X76D-X87D/R-X249R, X76D-X118R-X128R, X76D-X118R-X206L/Y, X76D-X118R-X209W, X76D-X118R-X222Q, X76D-X118R-X249R, X76D-X209W-X222Q, X76D-X209W-X249R, X78G/N-X87D/R-X118R, X78G/N-X87D/R-X129Q, X78G/N-X87D/R-X130A, X78G/N-X87D/R-X206L/Y, X78G/N-X87D/R-X209W, X78G/N-X87D/R-X222Q, X78G/N-X87D/R-X249R, X78G/N-X118R-X129Q, X78G/N-X118R-X209W, X78G/N-X118R-X222Q, X78G/N-X118R-X249R, X78G/N-X129Q-X130A, X78G/N-X209W-X222Q, X78G/N-X209W-X249R, X78G/N-X222Q-X249R, X87D/R-X118R-X206L, X87D/R-X118R-X209W, X87D/R-X118R-X249R, X87D/R-X206L/Y-X209W, X87D/R-X209W-X222Q, X87D/R-X209W-X249R, X87D/R-X222Q-X249R, X118R-X209W-X213A, X118R-X209W-X222Q, X118R-X209W-X249R, X118R-X222Q-X249R, X206L-X209W-X249R, X209W-X213A-X222Q, X209W-X213A-X249R, X209W-X222Q-X249R, and combinations thereof, (v) S3V-I8V, S3V-P40E, S3V-S78G/N, S3V-S87D, S3V-G118R, S3V-S128R, S3V-P129Q, S3V-S130A, S3V-P210I, S3V-G211P, S3V-A215K, S3V-L217K, S3V-N261I, S3V-L262Q, 18V-P40E, 18V-N76D, I8V-S87D, 18V-G118R, 18V-S128R, I8V-P210I, I8V-A215K, 18V-N261I, N18R-S78N, N18R-S87R, N18R-G118R, N18R-Q206L, S24R-S78N, S24R-S87D/R, S24R-Q206L/Y, S24R-Y209W, S24R-T213A, S24R-M222Q, P40E-N76D, P40E-S87D/R, P40E-G118R, P40E-S128R, P40E-P210I, P40E-A215K, P40E-L217K, P40E-N261I, N76D-S87D, N76D-P210I, N76D-S128R, N76D-Q206F/R/M/Y, N76D-P210I, N76D-G211P, N76D-T213A, N76D-A215K, N76D-L217K, N76D-H249R, N76D-N261I, N76D-L262Q, S78G-Q206F/L/M/Y, S78G-P210I, S78G-N261I, S78G/N-S87D/R, S78G/N-G118R, S78G/N-S128L, S78G/N-P129Q, S78G/N-S130A, S78N-T213A, S78N-M222Q, S78N-H249R, S87D-G118R, S87D-S128L/R, S87D-P129Q, S87D-S130A, S87D/R-Y209W, S87D-P210I, S87D-A215K, S87D-L217K, S87D/R-M222Q, S87D/R-H249R, S87R-Q206F/L/M/R/Y, S87R-T213A, S87D/R-N261I, G118R-S128R, G118R-Q206L/R/Y, G118R-Y209W, G118R-P210I, G118R-G211P, G118R-T213A, G118R-L217K, G118R-M222Q, G118R-H249R, G118R-N261I, G118R-L262Q, S128L-Q206F/L/M/R/Y, S128L-Y209W, S128R-P210I, S128R-A215K, S128R-L217K, S128R-N261I, P129Q-Q206F/L/M/R/Y, P129Q-Y209W, S130A-Q206F/L/M/R/Y, S130A-Y209W, Q206L/Y-T213A, Q206L/Y-M222Q, Q206L/Y-H249R, Y209W-T213A, Y209W-M222Q, Y209W-H249R, P210I-L217K, P210I-N261I, T213A-M222Q, T213A-H249R, A215K-N261I, M222Q-H249R, and combinations thereof, or (vi) S3V-N76D-G118R, N18R-S24R-Q206L/Y, N18R-S24R-Y209W, N18R-S24R-T213A, N18R-S24R-H249R, N18R-S87D/R-Y209W, N18R-G118R-Y209W, N18R-Q206L/Y-Y209W, N18R-Q206L/Y-H249R, N18R-Y209W-T213A, N18R-Y209W-M222Q, N18R-Y209W-H249R, N18R-T213A-H249R, S24R-N76D-S78G/N, S24R-N76D-S87D/R, S24R-N76D-G118R, S24R-N76D-Y209W, S24R-N76D-M222Q, S24R-N76D-H249R, S24R-S78G/N-S87D/R, S24R-S78G/N-G118R, S24R-S78G/N-Q206L, S24R-S78G/N-Y209W, S24R-S78G/N-M222Q, S24R-

S78G/N-H249R, S24R-S87D/R-G118R, S24R-S87D/R-Y209W, S24R-S87D/R-M222Q, S24R-S87D/R-H249R, S24R-G118R-Y209W, S24R-G118R-M222Q, S24R-G118R-H249R, S24R-Q206L/Y-Y209W, S24R-Q206L/Y-H249R, S24R-Y209W-T213A, S24R-Y209W-M222Q, S24R-Y209W-H249R, S24R-T213A-H249R, S24R-M222Q-H249R, N76D-S78G/N-S87D/R, N76D-S78G/N-G118R, N76D-S78G/N-P129Q, N76D-S78G/N-S130A, N76D-S78G/N-Q206L, N76D-S78G/N-Y209W, N76D-S78G/N-M222Q, N76D-S78G/N-H249R, N76D-S87D/R-G118R, N76D-S87D/R-Q206L/Y, N76D-S87D/R-Y209W, N76D-S87D/R-H249R, N76D-G118R-S128R, N76D-G118R-Q206L/Y, N76D-G118R-Y209W, N76D-G118R-M222Q, N76D-G118R-H249R, N76D-Y209W-M222Q, N76D-Y209W-H249R, S78G/N-S87D/R-G118R, S78G/N-S87D/R-P129Q, S78G/N-S87D/R-S130A, S78G/N-S87D/R-Q206L/Y, S78G/N-S87D/R-Y209W, S78G/N-S87D/R-M222Q, S78G/N-S87D/R-H249R, S78G/N-G118R-P129Q, S78G/N-G118R-Y209W, S78G/N-G118R-M222Q, S78G/N-G118R-H249R, S78G/N-P129Q-S130A, S78G/N-Y209W-M222Q, S78G/N-Y209W-H249R, S78G/N-M222Q-H249R, S87D/R-G118R-Q206L, S87D/R-G118R-Y209W, S87D/R-G118R-H249R, S87D/R-Q206L/Y-Y209W, S87D/R-Y209W-H249R, S87D/R-Y209W-M222Q, S87D/R-M222Q-H249R, G118R-Y209W-T213A, G118R-Y209W-M222Q, G118R-Y209W-H249R, G118R-M222Q-H249R, Q206L/Y-Y209W-H249R, Y209W-T213A-M222Q, Y209W-T213A-H249R, Y209W-M222Q-H249R, and combinations thereof, wherein said variant has proteolytic activity and the amino acid sequence of said variant further comprises one or more substitutions selected from: (i) 3, 76, 101, 103, 104, 118, 127, 128, 166, 210, 217, 222, and 261; (ii) X3V X76D, X101F/G/V, X103A/D/P, X104I, X118R, X127T, X128L/R, X166D/N, X210I, X217K, X222Q/S, and X261I; or (ii) S3V, N76D, S101F/G/V, S103A/D/P, V104I, G118R, G127T, S128L/R, S166D/N, P210I, L217K, M222Q/S, and N261I; and wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence.

A still further embodiment provides an isolated subtilisin variant comprising an amino acid sequence comprising a substitution at one, two, three, four, five or six positions selected from: 76, 87, 118, 128, 129, and 130; X76D, X87D/R/T, X118A/R/V, X128K/L/R, X129Q/R, and X130A/Q; or N76D, S87D/R/T, G118A/R/V, S128K/L/R, P129Q/R and S130A/Q in combination with one or more substitutions at one or more positions selected from: (i) 1, 3, 8, 9, 16, 18, 20, 22, 24, 28, 40, 42, 43, 44, 56, 77, 78, 82, 88, 89, 99, 100, 101, 103, 104, 108, 116, 120, 124, 127, 147, 150, 158, 159, 160, 166, 185, 188, 194, 204, 206, 209, 210, 211, 212, 213, 215, 216, 217, 218, 222, 232, 235, 241, 243, 245, 246, 248, 249, 251, 252, 254, 256, 259, 261, 262, 268, 270, and 271; (ii) X1V, X3I/T/V, X8V, X9G, X16T, X18K/R, X20E/R, X22L/W, X24F/L/P/R, X28T, X40E, X42I, X43R/S/Y, X44V, X56P, X77D, X78A/C/E/F/G/H/I/K/L/M/N/P/Q/R/T/V/W/Y, X82D, X88S, X89H, X99N, X100S, X101F/G/H/Q/T/V, X103A/D/P, X104I, X108S, X116L/M, X120R, X124M, X127S/T, X147I, X150T, X158E/T/V, X159D, X160Q, X166D/N, X185Y, X188D, X194D/P, X204D, X206A/D/F/G/H/L/M/N/P/R/S/Y, X209W, X210I, X211P, X212D, X213A, X215K/V, X216Y, X217K, X218S, X222L/Q/S, X232V, X235T, X241K, X243S, X245R, X246V, X248D, X249N/R, X251R, X252I, X254T, X256P, X259G, X261I, X262Q, X268A, X270P/T, and X271D; or (iii) A1V, S3I/T/V, 18V, S9G, A16T, N18K/R, G20E/R, T22L/W, S24F/L/P/R, V28T, P40E, L42I, N43R/S, I44V, S56P, N77D, S78A/C/E/F/G/H/I/K/L/M/N/P/Q/R/T/V/W/Y, L82D, A88S, E89H, S99N, G100S, S101F/G/H/Q/T/V, S103A/D/P, V104I, A108S, N116L/M, H120R, L124M, G127S/T, V147I, V150T, A158E/T/V, G159D, S160Q, S166D/N, N185Y, S188D, A194D/P, N204D, Q206A/D/F/G/H/L/M/N/P/R/S/Y, Y209W, P210I, G211P, S212D, T213A, A215K/V, S216Y, L217K, N218S, M222L/Q/S, A232V, K235T, W241K, N243S, Q245R, I246V, N248D, H249N/R, K251R, N252I, A254T, S256P, S259G, N261I, L262Q, V268A, A270P/T, and E271D; wherein X is any amino acid and said variant has proteolytic activity; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. A yet still further embodiment provides an isolated subtilisin variant comprising an amino acid sequence comprising a substitution at two, three, four, five or six positions selected from: 76, 87, 118, 128, 129, and 130; X76D, X87D/R, X118R/V, X128L, X129Q, and X130A; or N76D, S87D/R, G118R/V, S128L, P129Q and S130A in combination with one or more substitutions at one or more positions selected from: (i) 1, 3, 9, 16, 18, 20, 22, 24, 28, 42, 43, 44, 56, 77, 78, 99, 100, 101, 103, 104, 108, 116, 120, 124, 127, 150, 158, 159, 166, 185, 188, 194, 204, 206, 209, 212, 213, 217, 218, 222, 232, 235, 243, 245, 246, 249, 251, 254, 259, 268, and 270; (ii) X1V, X3T/V, X9G, X16T, X18K/R, X20E/R, X22L, X24F/P/R, X28T, X42I, X43R/S, X44V, X56P, X77D, X78N, X99N, X100S, X101F/G/H/T/V, X103A/D/P, X104I, X108S, X116L/M, X120R, X124M, X127T, X150T, X158E/T/V, X159D, X166D/N, X185Y, X188D, X194D, X204D, X206L/Y, X209W, X212D, X213A, X217K, X218S, X222L/Q/S, X232V, X235T, X243S, X245R, X246V, X249N/R, X251R, X254T, X259G, X268A, and X270P/T; or (iii) A1V, S3T/V, S9G, A16T, N18K/R, G20E/R, T22L, S24F/P/R, V28T, L42I, N43R/S, 144V, S56P, N77D, S78N, S99N, G100S, S101F/G/H/T/V, S103A/D/P, V104I, A108S, N116L/M, H120R, L124M, G127T, V150T, A158E/T/V, G159D, S166D/N, N185Y, S188D, A194D, N204D, Q206L/Y, Y209W, S212D, T213A, L217K, N218S, M222L/Q/S, A232V, K235T, N243S, Q245R, I246V, H249N/R, K251R, A254T, S259G, V268A, and A270P/T; wherein X is any amino acid and said variant has proteolytic activity; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. An even further embodiment provides an isolated subtilisin variant comprising an amino acid sequence comprising a substitution at one, two, three, four, five or six positions selected from: 76, 87, 118, 128, 129, and 130; X76D, X87D/R/T, X118A/R/V, X128K/L/R, X129Q/R, and X130A/Q; orN76D, S87D/R/T, G118A/R/V, S128K/L/R, P129Q/R and S130A/Q in combination with one or more substitutions at one or more positions selected from: (i) 3, 18, 24, 40, 78, 101, 103, 104, 127, 166, 206, 209, 210, 211, 213, 217, 222, 249, 261, and 262; (ii) X3V, X18R, X24R, X40E, X78G/N, X101F/G/V, X103A/D/P, X104I, X127T, X166D/N, X206L/R/Y, X209W, X210I, X211P, X213A, X217K, X222Q/S, X249N/R, X261I, and X262Q; or (iii) S3V, N18R, S24R, P40E, S78G/N, G127T, S166D/N, Q206L/R/Y, Y209W, P210I, G211P, T213A, L217K, M222Q/S, H249N/R, N261I, and L262Q; wherein X is any amino acid and said variant has proteolytic activity; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. A still yet further embodiment provides an isolated subtilisin variant comprising an amino acid sequence comprising a substitution at two, three, four, five or six positions selected from: 76, 87, 118, 128, 129, and 130; X76D, X87D/R, X118R/V, X128L, X129Q, and X130A; or N76D, S87D/R, G118R/V, S128L, P129Q and S130A in combination with one or more substitutions at one or more positions selected from: (i) 18, 24, 78, 101, 103, 104, 127, 166, 206, 209, 213, 222, and 249; (ii) X18R, X24R, X78N, X101F/G/V, X103A/D/P, X104I, X127T, X166D/N, X206L/Y, X209W, X213A, X222Q/S, and X249N/R; or (iii) N18R, S24R, S78N, S166D/N, Q206L, Y209W, T213A, M222Q/S, and H249N/R; wherein X is any amino acid and said variant has proteolytic activity; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. Yet an even further embodiment provides an isolated subtilisin variant comprising an amino acid sequence comprising a substitution at each of positions 76, 87, 118, 128, 129, and 130; X76D, X87R, X118R, X128L, X129Q, and X130A; or N76D, S87R, G118R, S128L, P129Q and S130A in combination with one or more substitutions at one or more positions selected from: (i) 3, 8, 18, 22, 24, 28, 40, 43, 78, 89, 99, 101, 103, 104, 108, 116, 124, 127, 147, 150, 158, 159, 166, 188, 194, 206, 209, 210, 211, 212, 213, 215, 217, 222, 232, 235, 243, 245, 246, 249,261, 262, 270, and 271; (ii) X3T/V, X8V, X18R, X22W, X24R, X28T, X40E, X43S, X78A/C/E/F/G/H/I/K/L/M/N/P/Q/R/T/V/W/Y, X89H, X99N, X101F/G/V, X103A/D/P, X104I, X108S, X116M, X124M, X127T, X147I, X150T, X158E/T, X159D, X166D, X188D, X194D/P, X206A/D/F/G/H/L/M/N/P/R/S/Y, X209W, X210I/L, X211P, X212D, X213A, X215V, X217K, X222Q/S, X232V, X235T, X243S, X245R, X246V, X249N/R, X261I, X262Q, X270T, and X271D; or (iii) S3T/V, I8V, N18R, T22W, S24R, V28T, P40E, N43S, S78A/C/E/F/G/H/I/K/L/M/N/P/Q/R/T/V/W/Y, E89H, S99N, S101F/G/V, S103A/D/P, V104I, A108S, N116M, L124M, G127T, V147I, V150T, A158E/T, G159D, S166D, S188D, A194D/P, Q206A/D/F/G/H/L/M/N/P/R/S/Y, Y209W, P210I/L, G211P, S212D, T213A, A215V, L217K, M222Q/S, A232V, K235T, N243S, Q245R, I246V, H249N/R, N261I, L262Q, A270T, and E271D; wherein X is any amino acid and said variant has proteolytic activity; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. An even still yet further embodiment provides an isolated subtilisin variant comprising an amino acid sequence comprising a substitution at each of positions 76, 87, 118, 128, 129, and 130; X76D, X87R, X118R, X128L, X129Q, and X130A; or N76D, S87R, G118R, S128L, P129Q and S130A in combination with one or more substitutions at one or more positions selected from: (i) 3, 18, 24, 28, 43, 78, 99, 100, 101, 103, 104, 108, 116, 124, 127, 150, 158, 159, 166, 188, 194, 206, 209, 212, 213, 217, 222, 232, 235, 243, 245, 246, 249, and 270; (ii) X3T/V, X18R, X24R, X28T, X43S, X78N, X99N, X100S, X101F/G/V, X103A/D/P, X104I, X108S, X116M, X124M, X127T, X150T, X158E/T, X159D, X166D, X188D, X194D, X206L, X209W, X212D, X213A, X217K, X222Q/S, X232V, X235T, X243S, X245R, X246V, X249N/R, and X270T; or (iii) S3V/T, N18R, S24R, V28T, N43S, S78N, S99N, G100S, S101F/G/V, S103A/D/P, V104I, A108S, N116M, L124M, G127T, V150T, A158E/T, G159D, S166D, S188D, A194D, Q206L, Y209W, S212D, T213A, L217K, M222Q/S, A232V, K235T, N243S, Q245R, I246V, H249N/R, and A270T; wherein X is any amino acid and said variant has proteolytic activity; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. An even yet still further embodiment provides an isolated subtilisin variant comprising an amino acid sequence comprising a substitution at each of positions 76, 87, 118, 128, 129, and 130; X76D, X87R, X118R, X128L, X129Q, and X130A; or N76D, S87R, G118R, S128L, P129Q and S130A in combination with one or more substitutions at one or more positions selected from: (i) 3, 18, 24, 78, 206, and 249; (ii) X3V, X18R, X24R, X78G/N, X206L/R/Y, and X249N/R; or (iii) S3V, N18R, S24R, S78G/N, Q206L/R/Y, and H249N/R; wherein X is any amino acid and said variant has proteolytic activity; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. A still further embodiment provides an isolated subtilisin variant comprising an amino acid sequence comprising a substitution at each of positions 76, 87, 118, 128, 129, and 130; X76N, X87R, X118R, X128L, X129Q, and X130A; or N76D, S87D/R, G118R, S128L, P129Q and S130A in combination with one or more substitutions at one or more positions selected from: (i) 18, 24, 78, 206, and 249; (ii) X18R, X24R, X78N, X206L, and X249N/R; or (iii) N18R, S24R, S78N, Q206L, and H249N/R; wherein X is any amino acid and said variant has proteolytic activity; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence.

In another embodiment, one or more subtilisin variant described herein further comprises a substitution at two or more positions selected from: (i) 3-8, 3-40, 3-78, 3-87, 3-118, 3-128, 3-129, 3-130, 3-210, 3-211, 3-215, 3-217, 3-261, 3-262, 8-40, 8-76, 8-87, 8-118, 8-128, 8-210, 8-215, 8-261, 18-78, 18-87, 18-118, 18-206, 24-87, 24-206, 24-209, 24-213, 24-222, 40-76, 40-87, 40-118, 40-128, 40-210, 40-215, 40-217, 40-261, 76-210, 76-211, 76-213, 76-215, 76-217, 76-249, 76-261, 76-262, 78-87, 78-118, 78-210, 78-213, 78-222, 78-249, 87-206, 87-209, 87-213, 87-215, 87-217, 87-222, 87-249, 87-261, 118-206, 118-209, 118-210, 118-211, 118-213, 118-215, 118-217, 118-222, 118-249, 118-261, 118-262, 128-209, 128-210, 128-215, 128-217, 128-261, 129-206, 129-209, 130-206, 130-209, 206-213, 206-249, 209-213, 209-249, 210-217, 210-261, 213-222, 213-249, 215-261, 222-249, and combinations thereof, (ii) 3-76-118, 18-24-206, 18-24-209, 18-24-213, 18-24-249, 18-87-209, 18-118-209, 18-206-209, 18-209-

213, 18-209-222, 18-209-249, 18-213-249, 24-76-78, 24-76-87, 24-76-118, 24-76-209, 24-76-222, 24-76-249, 24-78-87, 24-78-118, 24-78-206, 24-78-209, 24-78-222, 24-78-249, 24-87-118, 24-87-209, 24-87-222, 24-87-249, 24-118-209, 24-118-222, 24-118-249, 24-206-209, 24-206-249, 24-209-213, 24-209-222, 24-209-249, 24-213-249, 24-222-249, 76-78-118, 76-78-87, 76-78-129, 76-78-130, 76-78-206, 76-78-209, 76-78-222, 76-78-249, 76-87-118, 76-87-206, 76-87-209, 76-87-249, 76-118-128, 76-118-206, 76-118-209, 76-118-222, 76-118-249, 76-209-222, 76-209-249, 78-87-118, 78-87-129, 78-87-130, 78-87-206, 78-87-209, 78-87-222, 78-87-249, 78-118-129, 78-118-209, 78-118-222, 78-118-249, 78-129-130, 78-209-222, 78-209-249, 78-222-249, 87-118-206, 87-118-209, 87-118-249, 87-206-209, 87-209-222, 87-209-249, 87-222-249, 118-209-213, 118-209-222, 118-209-249, 118-222-249, 206-209-249, 209-213-222, 209-213-249, 209-222-249, and combinations thereof, (iii) X3V-X8V, X3V-X40E, X3V-X78G/N, X3V-X87D, X3V-X118R, X3V-X128R, X3V-X129Q, X3V-X130A, X3V-X210I, X3V-X211P, X3V-X215K, X3V-X217K, X3V-X261I, X3V-X262Q, X8V-X40E, X8V-X76D, X8V-X87D, X8V-X118R, X8V-X128R, X8V-X210I, X8V-X215K, X8V-X261I, X18R-X78N, X18R-X87R, X18R-X118R, X18R-X206L, X24R-S78N, X24R-X87D/R, X24R-X206L/Y, X24R-X209W, X24R-X213A, X24R-X222Q, X40E-X76D, X40E-X87D/R, X40E-X118R, X40E-X128R, X40E-X210I, X40E-X215K, X40E-X217K, X40E-X261I, X76D-X87D, X76D-X128R, X76D-X206F/R/M/Y, X76D-X210I, X76D-X211P, X76D-X213A, X76D-X215K, X76D-X217K, X76D-X249R, X76D-X261I, X76D-X262Q, X78G-X206F/L/M/Y, X78G-X210I, X78G-X261I, X78G/N-X87D/R, X78G/N-X118R, X78G/N-X128L, X78G/N-X129Q, X78G/N-X130A, X78N-X213A, X78N-X222Q, X78N-X249R, X87D-X118R, X87D-X128L/R, X87D-X129Q, X87D-X130A, X87D/R-X209W, X87D-X210I, X87D-X215K, X87D-X217K, X87D/R-X222Q, X87D/R-X249R, X87R-X206F/L/M/R/Y, X87R-X213A, X87D/R-X261I, X118R-X128R, X118R-X206F/M/L/R/Y, X118R-X209W, X118R-X210II, X118R-X211P, X118R-X213A, X118R-X215K, X118R-X217K, X118R-X222Q, X118R-X249R, X118R-X261I, X118R-X262Q, X128L-X206F/L/M/R/Y, X128L-X209W, X128R-P210I, X128R-X215K, X128R-L217K, X128R-N261I, X129Q-X206F/L/M/R/Y, X129Q-X209W, X130A-X206F/L/M/R/Y, S130A-Y209W, X206L/Y-X213A, X206L/Y-X222Q, X206L/Y-X249R, X209W-X213A, X209W-X222Q, X209W-X249R, X210I-X217K, X210I-X261I, X213A-X222Q, X213A-X249R, X215K-X261I, X222Q-X249R, and combinations thereof, (iv) X3V-X76D-X118R, X18R-X24R-X206L/Y, X18R-X24R-X209W, X18R-X24R-X213A, X18R-X24R-X249R, X18R-X87D/R-X209W, X18R-X118R-X209W, X18R-X206L/Y-X209W, X18R-X206L/Y-X249R, X18R-X209W-X213A, X18R-X209W-X222Q, X18R-X209W-X249R, X18R-X213A-X249R, X24R-X76D-X78G/N, X24R-X76D-X87D/R. X24R-X76D-X118R, X24R-X76D-X209W, X24R-X76D-X222Q, X24R-X76D-X249R, X24R-X78G/N-X87D/R, X24R-X78G/N-X118R, X24R-X78G/N-X206L/Y, X24R-X78G/N-X209W, X24R-X78G/N-X222Q, X24R-X78G/N-X249R, X24R-X87D/R-X118R, X24R-X87D/R-X209W, X24R-X87D/R-X222Q, X24R-X87D/R-X249R, X24R-X118R-X209W, X24R-X118R-X222Q, X24R-X118R-X249R, X24R-X206L-X209W, X24R-X206L/Y-X249R, X24R-X209W-X213A, X24R-X209W-X222Q, X24R-X209W-X249R, X24R-X213A-X249R, X24R-X222Q-X249R, X76D-X78G/N-X87D/R, X76D-X78G/N-X118R, X76D-X78G/N-X129Q, X76D-X78G/N-X130A, X76D-X78G/N-X206L, X76D-X78G/N-X209W, X76D-X78G/N-X222Q, X76D-X78G/N-X249R, X76D-X87D/R-X118R, X76D-X87D/R-X206L/Y, X76D-X87D/R-X209W, X76D-X87D/R-X249R, X76D-X118R-X128R, X76D-X118R-X206L/Y, X76D-X118R-X209W, X76D-X118R-X222Q, X76D-X118R-X249R, X76D-X209W-X222Q, X76D-X209W-X249R, X78G/N-X87D/R-X118R, X78G/N-X87D/R-X129Q, X78G/N-X87D/R-X130A, X78G/N-X87D/R-X206L/Y, X78G/N-X87D/R-X209W, X78G/N-X87D/R-X222Q, X78G/N-X87D/R-X249R, X78G/N-X118R-X129Q, X78G/N-X118R-X209W, X78G/N-X118R-X222Q, X78G/N-X118R-X249R, X78G/N-X129Q-X130A, X78G/N-X209W-X222Q, X78G/N-X209W-X249R, X78G/N-X222Q-X249R, X87D/R-X118R-X206L, X87D/R-X118R-X209W, X87D/R-X118R-X249R, X87D/R-X206L/Y-X209W, X87D/R-X209W-X222Q, X87D/R-X209W-X249R, X87D/R-X222Q-X249R, X118R-X209W-X213A, X118R-X209W-X222Q, X118R-X209W-X249R, X118R-X222Q-X249R, X206L-X209W-X249R, X209W-X213A-X222Q, X209W-X213A-X249R, X209W-X222Q-X249R, and combinations thereof, or (v) S3V-18V, S3V-P40E, S3V-S78G/N, S3V-S87D, S3V-G118R, S3V-S128R, S3V-P129Q, S3V-S130A, S3V-P210I, S3V-G211P, S3V-A215K, S3V-L217K, S3V-N261I, S3V-L262Q, 18V-P40E, 18V-N76D, 18V-S87D, I8V-G118R, 18V-S128R, I8V-P210I, I8V-A215K, I8V-N261I, N18R-S78N, N18R-S87R, N18R-G118R, N18R-Q206L, S24R-S78N, S24R-S87D/R, S24R-Q206L/Y, S24R-Y209W, S24R-T213A, S24R-M222Q, P40E-N76D, P40E-S87D/R, P40E-G118R, P40E-S128R, P40E-P210I, P40E-A215K, P40E-L217K, P40E-N261I, N76D-S87D, N76D-P210I, N76D-S128R, N76D-Q206F/R/M/Y, N76D-P210I, N76D-G211P, N76D-T213A, N76D-A215K, N76D-L217K, N76D-H249R, N76D-N261I, N76D-L262Q, S78G-Q206F/L/M/Y, S78G-P210I, S78G-N261I, S78G/N-S87D/R, S78G/N-G118R, S78G/N-S128L, S78G/N-P129Q, S78G/N-S130A, S78N-T213A, S78N-M222Q, S78N-H249R, S87D-G118R, S87D-S128L/R, S87D-P129Q, S87D-S130A, S87D/R-Y209W, S87D-P210I, S87D-A215K, S87D-L217K, S87D/R-M222Q, S87D/R-H249R, S87R-Q206F/L/M/R/Y, S87R-T213A, S87D/R-N261I, G118R-S128R, G118R-Q206L/R/Y, G118R-Y209W, G118R-P210I, G118R-G211P, G118R-T213A, G118R-L217K, G118R-M222Q, G118R-H249R, G118R-N261I, G118R-L262Q, S128L-Q206F/L/M/R/Y, S128L-Y209W, S128R-P210I, S128R-A215K, S128R-L217K, S128R-N261I, P129Q-Q206F/L/M/R/Y, P129Q-Y209W, S130A-Q206F/L/M/R/Y, S130A-Y209W, Q206L/Y-T213A, Q206L/Y-M222Q, Q206L/Y-H249R, Y209W-T213A, Y209W-M222Q, Y209W-H249R, P210I-L217K, P210I-N261I, T213A-M222Q, T213A-H249R, A215K-N261I, M222Q-H249R, and combinations thereof, or (vi) S3V-N76D-G118R, N18R-S24R-Q206L/Y, N18R-S24R-Y209W, N18R-S24R-T213A, N18R-S24R-H249R, N18R-S87D/R-Y209W, N18R-G118R-Y209W, N18R-Q206L/Y-Y209W, N18R-Q206L/Y-H249R, N18R-Y209W-T213A, N18R-Y209W-M222Q, N18R-Y209W-H249R, N18R-T213A-H249R, S24R-N76D-S78G/N, S24R-N76D-S87D/R, S24R-N76D-G118R, S24R-N76D-Y209W, S24R-N76D-M222Q, S24R-N76D-H249R, S24R-S78G/N-S87D/R, S24R-S78G/N-G118R, S24R-S78G/N-Q206L, Y209W S24R-S78G/N-Y209W, S24R-S78G/N-M222Q, S24R-S78G/N-H249R, S24R-S87D/R-G118R, S24R-S87D/R-Y209W, S24R-S87D/R-M222Q, S24R-S87D/R-H249R, S24R-G118R-Y209W, S24R-G118R-M222Q, S24R-G118R-H249R, S24R-Q206L/Y-Y209W, S24R-Q206L/Y-H249R, S24R-Y209W-T213A, S24R-Y209W-M222Q, S24R-Y209W-

H249R, S24R-T213A-H249R, S24R-M222Q-H249R, N76D-S78G/N-S87D/R, N76D-S78G/N-G118R, N76D-S78G/N-P129Q, N76D-S78G/N-S130A, N76D-S78G/N-Q206L, N76D-S78G/N-Y209W, N76D-S78G/N-M222Q, N76D-S78G/N-H249R, N76D-S87D/R-G118R, N76D-S87D/R-Q206L/Y, N76D-S87D/R-Y209W, N76D-S87D/R-H249R, N76D-G118R-S128R, N76D-G118R-Q206L/Y, N76D-G118R-Y209W, N76D-G118R-M222Q, N76D-G118R-H249R, N76D-Y209W-M222Q, N76D-Y209W-H249R, S78G/N-S87D/R-G118R, S78G/N-S87D/R-P129Q, S78G/N-S87D/R-S130A, S78G/N-S87D/R-Q206L/Y, S78G/N-S87D/R-Y209W, S78G/N-S87D/R-M222Q, S78G/N-S87D/R-H249R, S78G/N-G118R-P129Q, S78G/N-G118R-Y209W, S78G/N-G118R-M222Q, S78G/N-G118R-H249R, S78G/N-P129Q-S130A, S78G/N-Y209W-M222Q, S78G/N-Y209W-H249R, S78G/N-M222Q-H249R, S87D/R-G118R-Q206L, S87D/R-G118R-Y209W, S87D/R-G118R-H249R, S87D/R-Q206L/Y-Y209W, S87D/R-Y209W-H249R, S87D/R-Y209W-M222Q, S87D/R-M222Q-H249R, G118R-Y209W-T213A, G118R-Y209W-M222Q, G118R-Y209W-H249R, G118R-M222Q-H249R, Q206L/Y-Y209W-H249R, Y209W-T213A-M222Q, Y209W-T213A-H249R, Y209W-M222Q-H249R, and combinations thereof.

Yet another embodiment is directed to an isolated subtilisin variant comprising an amino acid sequence comprising a substitution at two or more positions selected from: (i) S3V-S78N, N18R-G20R, N18R-S24R, N18R-N43R, N18R-R45T, N18R-H249R, G20R-N43R, G20R-R45T, G20R-H249R, T22L-S24F, T22L-S78N, T22L-S166D, T22L-T213A, S24R/F-S78N, S24R-N43R, S24R-Y209W, S24F-S166D, S24R/F-T213A, S24R-H249R, S24R-M222Q, N43R-Y209W, N43R-H249R, N43R-R45T, R45T-H249R, S78G/N-Q206Y/F, S78N-S166D, S78N-T213A, S101A-S188D, S101A-P210I, S101A-A232V, S103A-S188D, S103A-P210I, S103A-A232V, V104I-S188D, V104I-P210I, V104I-A232V, S166D-T213A, S188D-P210I, S188D-A232V, S188D-Q245R, P210I-A232V, A232V-Q245R, Q206Y-T213A, Q206L/Y-M222Q, Q206L-H249R, M222Q-H249R, Y209W-M222Q, T213A-H249R, Y209W-H249R, and combinations thereof, (ii) S3V-S78N-S87R, S3V-S78N-G118R, N18R-S24R-N76D, N18R-N76D-H249R, S24R-N43R-N76D, S24R-N76D-H249R, S24F-S78N-G118R, S24F-G118R-S166D, S78N-G118R-S166D, T22L-S24F-G118R, T22L-S78N-G118R, T22L-G118R-S166D, T22L-G118R-T213A, S24F-G118R-T213A, S78N-G118R-T213A, N18R-G20R-N76D, N18R-N43R-N76D, N18R-R45T-N76D, G20R-N76D-H249R, G20R-N43R-N76D, G20R-R45T-N76D, S24R-Y209W-G118R, S24R-G118R-M222Q, S24R-G118R-H249R, N43R-G118R-Y209W, N43R-R45T-N76D, N43R-N76D-H249R, R45T-N76D-H249R, N76D-S101A-S188D, N76D-S101A-P210I, N76D-S101A-A232V, N76D-S103A-S188D, N76D-S103A-P210I, N76D-S103A-A232V, N76D-V104I-S188D, N76D-V104I-P210I, N76D-V104I-A232V, N76D-S188D-P210I, N76D-S188D-A232V, N76D-P210I-A232V, N76D-Q206Y-T213A, N76D-S24R-Q206Y, N76D-S24R-M222Q, N76D-Q206Y-M222Q, N76D-T213A-H249R, N76D-T213A-M222Q, N76D-M222Q-H249R, N76D-S78N-S87R, N76D-S78N-G118R, N76D-S78N-S128L, N76D-S78N-P129Q, N76D-S78N-S130A, N76D-S87R-Q206L, N76D-G118R-Q206L, N76D-S128L-Q206L, N76D-P129Q-Q206L, N76D-S130A-Q206L, N76D-Q206L-H249R, S78G-S87R-Q206Y/F, S78G-G118R-Q206Y/F, S78N-G118R-Y209W, S78N-S87D-G118R, S78N-S87D-Q206Y, S87D-Y209W-G118R, S87D-G118R-M222Q, S87D-G118R-H249R, G118R-Q206L-M222Q, G118R-Y209W-M222Q, G118R-M222Q-H249R, Y209W-G118R-M222Q, Y209W-G118R-H249R, and combinations thereof, or (iii) S3V-S78N-S87R-G118R, S3V-N76D-S78N-G118R-P129Q, N18R-S24R-N76D-H249R-N18R-S24R-N76D-S78N-Q206L, S24F-S78N-G118R-S166D, S24R-N76D-S78N-Q206L-H249R, S24R-S78N-G118R-Q206L-M222Q, S24R-N43R-G118R-Y209W, T22L-S24F-S78N-G118R-S166D-T213A, N18R-G20R-N43R-R45T-N76D-H249R, N76D-S101A-S103A-V104I-S188D-P210I-A232V-Q245R, G20R-S24R-N43R-N76D, N76D-S78N-S87R-G118R-S128L-P129Q-S130A, N76D-S87R-G118R-S128L-P129Q-S130A-Q206L, N76D-S78N-S87R-G118R-S128L-P129Q-S130A-Q206L, S24R-N76D-S87R-Q206Y-T213A-M222Q-H249R, S24R-N76D-S78N-S87D-G118R-Y209W-M222Q-H249R, N76D-S78N-S87R-G118R-S128L-P129Q-S130A-Y209W, N76D-S78N-S87D-Q206Y, and S78G-S87R-G118R-Q206Y/F; wherein said substitution at two or more positions is further combined with one or more substitutions selected from 76, 87, 118, 128, 129, and 130; X76D, X87R, X118R, X128L, X129Q, and X130A; or N76D, S87R, G118R, S128L, P129Q and S130A; wherein X is any amino acid and said variant has proteolytic activity; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence.

An even further embodiment is directed to an isolated subtilisin variant comprising an amino acid sequence comprising a substitution at two or more positions selected from: (i) N18R-G20R, N18R-S24R, N18R-N43R, N18R-R45T, N18R-H249R, G20R-N43R, G20R-R45T, G20R-H249R, T22L-S24F, T22L-S78N, T22L-S166D, T22L-T213A, S24R/F-S78N, S24R-Y209W, S24F-S166D, S24R/F-T213A, S24R-H249R, S24R-M222Q, N43R-H249R, N43R-R45T, R45T-H249R, S78N-S166D, S78N-Q206L, S78N-Y209W, S78N-T213A, S101A-S188D, S101A-P210I, S101A-A232V, S103A-S188D, S103A-P210I, S103A-A232V, V104I-S188D, V104I-P210I, V104I-A232V, S166D-T213A, S188D-P210I, S188D-A232V, S188D-Q245R, P210I-A232V, A232V-Q245R, Q206Y-T213A, Q206Y-M222Q, M222Q-H249R, Y209W-M222Q, T213A-H249R, Y209W-H249R, and combinations thereof, or (ii) N18R-S24R-N76D, N18R-N76D-H249R, S24R-N76D-H249R, S24F-S78N-G118R, S24F-G118R-S166D, S78N-G118R-S166D, T22L-S24F-G118R, T22L-S78N-G118R, T22L-G118R-S166D, T22L-G118R-T213A, S24F-G118R-T213A, S78N-G118R-T213A, N18R-G20R-N76D, N18R-N43R-N76D, N18R-R45T-N76D, G20R-N76D-H249R, G20R-N43R-N76D, G20R-R45T-N76D, N43R-R45T-N76D, N43R-N76D-H249R, R45T-N76D-H249R, N76D-S101A-S188D, N76D-S101A-P210I, N76D-S101A-A232V, N76D-S103A-S188D, N76D-S103A-P210I, N76D-S103A-A232V, N76D-V104I-S188D, N76D-V104I-P210I, N76D-V104I-A232V, N76D-S188D-P210I, N76D-S188D-A232V, N76D-P210I-A232V, N76D-Q206Y-T213A, N76D-S24R-Q206Y, N76D-S24R-M222Q, N76D-Q206Y-M222Q, N76D-T213A-H249R, N76D-T213A-M222Q, N76D-M222Q-H249R, N76D-S78N-S87R, N76D-S78N-G118R, N76D-S78N-S128L, N76D-S78N-P129Q, N76D-S78N-S130A, N76D-S87R-Q206L, N76D-G118R-Q206L, N76D-S128L-Q206L, N76D-P129Q-Q206L, N76D-S130A-Q206L, S24R-Y209W-G118R, S24R-G118R-M222Q, S24R-G118R-H249R, Y209W-G118R-M222Q, Y209W-G118R-H249R, S78N-S87D-G118R, S87D-Y209W-G118R, S87D-G118R-M222Q, S87D-G118R-

H249R, G118R-Y209W-M222Q, G118R-M222Q-H249R, and combinations thereof, wherein said substitution at two or more positions is further combined with one or more substitution at each of positions 76, 87, 118, 128, 129, and 130; X76N, X87R, X118R, X128L, X129Q, and X130A; orN76D, S87D/R, G118R, S128L, P129Q and S130A; wherein X is any amino acid and said variant has proteolytic activity; and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence.

A further embodiment is directed to an isolated subtilisin variant comprising an amino acid sequence comprising two or more substitutions selected from S3V-N76D, S24R-N76D, S24R-G118R, S24R-H249R, N76D-S78G, N76D-S78N, N76D-Q206L, N76D-Y209W, N76D-M222Q, S78N-Q206L, S78N-Y209W, N76D-S78N-Y209W, N76D-S78N-Q206L, N76D-Q206L-Y209W, and combinations thereof, wherein said substitutions at two or more positions is further combined with one or more substitutions selected from: (i) A1V, S3I/T/V, 18V, S9G, A16T, N18K/R, G20E/R, T22L/W, S24F/L/P/R, V28T, P40E, L42I, N43R/S, I44V, S56P, N77D, S78A/C/E/F/G/H/I/K/L/M/N/P/Q/R/T/V/W/Y, L82D, A88S, E89H, S99N, G100S, S101F/G/H/Q/T/V, S103A/D/P, V104I, A108S, N116L/M, H120R, L124M, G127S/T, V147I, V150T, A158E/T/V, G159D, S160Q, S166D/N, N185Y, S188D, A194D/P, N204D, Q206A/D/F/G/H/L/M/N/P/R/S/Y, Y209W, P210I, G211P, S212D, T213A, A215K/V, S216Y, L217K, N218S, M222L/Q/S, A232V, K235T, W241K, N243S, Q245R, I246V, N248D, H249N/R, K251R, N252I, A254T, S256P, S259G, N261I, L262Q, V268A, A270P/T, and E271D; (ii) S3T/V, I8V, N18R, T22W, S24R, V28T, P40E, N43S, S78A/C/E/F/G/H/I/K/L/M/N/P/Q/R/T/V/W/Y, E89H, S99N, S101F/G/V, S103A/D/P, V104I, A108S, N116M, L124M, G127T, V147I, V150T, A158E/T, G159D, S166D, S188D, A194D/P, Q206A/D/F/G/H/L/M/N/P/R/S/Y, Y209W, P210I/L, G211P, S212D, T213A, A215V, L217K, M222Q/S, A232V, K235T, N243S, Q245R, I246V, H249N/R, N261I, L262Q, A270T, and E271D; (iii) S3V, I8V, S24R, P40E, N76D, S78G/N, S87D/R, GI18R, S128L/R, P129Q, S130A, Q206F/L/M/Y, Y209W, P210I, T213A, A215K, L217K, M222Q, H249R, and N261I; (iv) I8V, P40E, S87D/R, S128L/R, P129Q, S130A, P210I, T213A, A215K, L217K, and N261I; (v) S3V, N18R, S24R, P40E, S78G/N, G127T, S166D/N, Q206L/R/Y, Y209W, P210I, G211P, T213A, L217K, M222Q/S, H249N/R, N261I, and L262Q; or (vi) S3V, N18R, S24R, S78G/N, Q206L/R/Y, and H249N/R; wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence.

A yet even further embodiment is directed to an isolated subtilisin variant comprising a combination of amino acid substitutions selected from: N18R-S87R-G118R-S166N-N204D-Q206L-Y209W; N18R-S24R-L42I-G118R-Y209W-T213A-M222Q-H249R; N18R-S24R-Y209W-T213A-H249R; N18R-S24R-S87R-G118R-S128L-P129Q-S130A-Q206Y-Y209W-T213A-H249R; S24R-S87D-G118R-Y209W-T213A-H249R; S9G-N18R-S24R-N76D-G118R-S166N-Q206L-H249R; N18R-S24R-Q206L-Y209W-T213A-M222Q-H249R; S24R-S87R-S166N-N18R-S24R-S87R-Q206L-Y209W-T213A; N18R-S24R-G118R-A158V-Y209W; N18R-S24R-S87D-Q206L-Y209W-M222Q-H249R; N18-S24R-S87R-G127T; S24R-S166N-Y209W-T213A; N76D-S78N-G118R-Y209W-H249R; N18R-N76D-S78N-S87R-Q206L-Y209W-H249R-S259G; N18R-S24R-S87D-N185Y-Q206L-Y209W-T213A-M222Q-H249R; S24R-G118R-G127T-Y209W; A1V-N18R-S24R-S56P-G127T-Q206L-Y209W; S87R-Y209W; N18R-S87D-Y209W-M222Q-H249R; N18R-S24R-G118R-S128L-P129Q-S130A-S166D-Y209W-T213A; S87D-S166D-T213A-H249R; N18R-S24P-S87D-S166N-Q206L-Y209W-M222Q-H249R; N76D-S166N-Y209W-T213A-H249R; S24R-Q206L-Y209W-T213A-M222Q-H249R; N18R-G118R-Q206L-Y209W; N18R-S24R-S166D-Q206Y-H249R-A254T; N18R-S24R-S78N-Q206L-Y209W-T213A-M222Q-H249R; N18R-S24R-G118R-G127T-Y209W; S24R-N76D-G118R-S166N-Q206L-Y209W; S24R-N76D-S87R-Y209W-T213A-M222Q-H249R; N18K-S87R-Y209W-T213A-M222Q-H249R; N18R-S24R-S87R-Y209W; N18R-S78N-G118R-Y209W-T213A-M222Q-H249R-A270P; N18R-S166N-Y209W-T213A-M222Q; N76D-S78N-S87R-S103P-GI18R-S128L-P129Q-S130A-Q206L; N76D-S78N-S87R-G118R-S128L-P129Q-S130A-Q206L-N243S; N76D-S78N-S87R-G118R-S128L-P129Q-S130A-Q206L-H249R; N18R-N76D-S78N-S87R-G118R-S128L-P129Q-S130A-Q206L; N18R-N76D-S78N-S87R-G118R-S128L-P129Q-S130A-Q206L-H249R; N18R-S24R-N76D-S78N-S87R-G118R-S128L-P129Q-S130A-Q206L-H249N; N18R-S24R-N76D-S78N-S87R-S99N-G118R-S128L-P129Q-S130A-A158T-Q206L-I246V-H249R; S24R-N76D-S78N-S128L-P129Q-S130A-Q206L-H249R; N18R-S24R-N76D-S78N-S128L-P129Q-S130A-Q206L-H249R; N76D-S78N-G118R-Q206L-H249R; N18-I44V-N76D-S78N-S87R-S128L-P129Q-S130A-Q206L-H249R; N18R-N76D-S78N-S87R-Q206L-H249R; N18R-S24R-N76D-S78N-S87R-S128L-P129Q-S130A-Q206L; N76D-S78N-G118R-Q206L; A16T-N18R-S24R-N76D-S78N-G118R-S128L-P129Q-S130A-Q206L; N18R-S24R-N76D-S78N-S87R-G118R-S128L-P129Q-S130A-Q206L-K235T; S24R-N76D-S78N-Q206L-H249R; S24R-N76D-S78N-S87R-S128L-P129Q-S130A-Q206L; N18R-N76D-S78N-S87R-S128L-P129Q-S130A-Q206L; N18R-S24R-N76D-S78N-S128L-P129Q-S130A; S24R-N76D-S78N-H249R; N18R-S24R-N76D-S78N-S87R-G118R-S128L-P129Q-S130A-Q206L-A270T; N18R-S24R-N76D-S78N-G118R-S128L-P129Q-S130A-H249R; N18R-S24R-N76D-S78N-M222Q-H249R; N76D-S78N-S87R-Q206L-H249R; N18R-N76D-S78N-Q206L-H249R; N18R-S24R-N76D-S78N-G118R-Q206L-K251R; N76D-S78N-Q206L-H249R; N18R-S24R-N76D-S78N-S87R-Q206L; N18R-S24R-N76D-S78N-G118R-S128L-P129Q-S130A; N76D-S78N-H120R-Q206L-H249R; N18R-N76D-S78N-S87R-S128L-P129Q-S130A-Q206L-H249R; N18R-G20E-N76D-S78N-G118R-H249R; S24R-N76D-S78N-G118R-S128L-P129Q-S130A; N76D-S78N-G118R-S128L-P129Q-S130A-Q206L-H249R; S24R-N76D-S78N-G118R-Q206L; N18R-N76D-S78N-S128L-P129Q-S130A-Q206L-V268A; N18R-N76D-S78N-S87R-Q206L-N218S-M222Q-H249R; N18R-S24R-N76D-S78N-G118R-S128L-P129Q-S130A-H249R; N76D-S78N-S87R-G118R-S128L-P129Q-S130A; N18R-S24R-N76D-S78N-H249R; N18R-S24R-N76D-S78N-S87R-G118R-S128L-P129Q-S130A-H249R; N18R-S24R-N76D-S78N-S87R-H249R; N76D-S78N-S87R-G118R-S128L-P129Q-S130A-Q206L; N76D-S78N-S87R-G118R-S128L-P129Q-S130A-Q206L; N18R-S24R-N76D-S78N-Q206L-H249R; N18R-S24R-N76D-S78N-S87R-G118R-S128L-P129Q-S130A-Q206L-H249R; N76D-S78N-S87R-G118R-S128L-P129Q-S130A-M222Q; S24R-N76D-S87R-Q206Y-T213A-

M222Q-H249R; S24R-N76D-S78N-S87D-G118R-Y209W-M222Q-H249R; S87D-Q206L-Y209W-T213A-H249R; S24R-N76D-S78N-S87R-G118R-Q206L-M222Q; S24R-N76D-S78N-S87R-G118R-Q206L-M222Q; N76D-S78N-S87R-G118R-S128L-P129Q-Q206L-M222Q; N76D-S78N-S87R-G118R-P129Q-Q206L-M222Q; N76D-S78N-S87R-G118R-S130A-Q206L-M222Q; N76D-S78N-S87R-G118R-S128L-P129Q-Q206L; N76D-S78N-S87R-G118R-S128L-S130A-Q206L; N76D-S78N-S87R-G118R-S128L-Q206L; N76D-S78N-S87R-G118R-P129Q-Q206L; N76D-S78N-S87R-G118R-S130A-Q206L; N76D-S78N-S87R-G118R-Q206L-M222Q; N76D-S78N-S87R-G118R-Q206L; S24R-N76D-S78N-S87R-G118R-Y209W-M222Q; S24R-N43R-N76D-S78N-S87R-G118R-Y209W-M222Q; G20R-S24R-N43R-N76D-S78N-S87R-G118R-Y209W-M222Q; G20R-N43R-N76D-S78N-S87R-G118R-Y209W-M222Q; S24R-N76D-S78N-S87R-G118R-Q206L-Y209W-T213A-M222Q; S24R-N76D-S78N-S87R-G118R-Q206L-T213A-M222Q; S24R-N76D-S78N-S87R-G118R-Y209W-T213A-M222Q; S24R-N76D-S78N-S87R-N116L-G118R-Y209W-M222Q; G20R-S24R-N43R-N76D-S78N-S87R-N116L-G118R-Y209W-M222Q; N18R-N76D-S87R-S128L-P129Q-S130A-Q206L-Y209W-H249R; N18R-S87R-S166N-Q206L-Y209W; N18R-S24R-N76D-S78N-S87R-G118R-G127T-Y209W-T213A; N18R-S24R-S166D-Q206Y-H249R; S24R-S78N-S87R-S166D-Q206L-Y209W-H249R; S3V-N76D-S78N-S87R-G118R-S128L-P129Q-S130A-Q206L; N76D-S78N-S87R-S101V-G118R-S128L-P129Q-S130A-Q206L; N76D-S78N-S87R-G118R-G127T-S128L-P129Q-S130A-Q206L; N76D-S78N-S87R-S101G-S103A-V104I-G118R-Q206L; N76D-S78N-S87R-G118R-G127T-Q206L; N76D-S78N-S87R-G118R-G127T-P129Q-Q206L; N76D-S78N-S87R-G118R-G127T-P129Q-S130A-Q206L; N76D-S78N-S87R-S101G-S103A-V104I-G118R-G127T-P129R-Q206L; N76D-S78N-S87R-G118R-S128L-P129Q-S130A-Q206L-S212D; N76D-S78N-S87R-G118R-S128L-P129Q-S130A-S166D-Q206L; S3V-N76D-S78N-S87R-S101G-S103A-V104I-G118R-S128L-P129Q-S130A-Q206L; N76D-S78N-S87R-G118R-S128L-P129Q-S130A-Q206L-T213A; N76D-S78N-S87R-G118R-S128L-P129Q-S130A-Q206L-A232V-Q245R; N76D-S78N-S87R-G118R-S128L-P129Q-S130A-G159D-S188D-Q206L-A232V-Q245R; S3V-S24R-N76D-S78N-S87D-G118R-Y209W-M222Q-H249R; S24R-N76D-S78N-S87D-S101V-G118R-Y209W-M222Q-H249R; S24R-N76D-S78N-S87D-S101G-S103A-V104I-G118R-Y209W-M222Q-H249R; S24R-N76D-S78N-S87D-G118R-Y209W-M222Q-H249R-S212D; S3V-S24R-N76D-S78N-S87D-S101G-S103A-V104I-G118R-Y209W-M222Q-H249R; S24R-N76D-S78N-S87D-S101G-S103A-V104I-G118R-G127T-Y209W-T213A-M222Q-H249R; S024R-N074D-S76N-S085D-S099G-S101A-V102I-G116R-Y203W-M216Q-A226V-Q239R-H243R; S24R-N76D-S78N-S87D-S101G-S103A-V104I-G118R-Y209W-H249R; S3V-S24R-N76D-S78N-S87D-S101G-S103A-V104I-G118R-Y209W-H249R; S24R-N76D-S78N-S87D-S101G-S103A-V104I-G118R-G127T-Y209W-T213A-H249R; S24R-N76D-S78N-S87D-S101T-G118R-Y209W-M222Q-H249R; S24R-N76D-S78N-S87D-S101H-G118R-Y209W-M222Q-H249R; S24R-N76D-S78N-S87D-G118R-P129Q-Y209W-M222Q-H249R; N76D-S78N-S87D-G118R-S128L-P129Q-S130A-Q206L; S24R-N76D-S78N-S87R-G118R-S128L-P129Q-S130A-Q206L-H249R; N18R-S24R-N76D-S78N-S87R-G118R-S128L-P129Q-S130A-Q206L; S24R-N76D-S78N-S87R-G118R-S128L-P129Q-S130A-Q206L; S24R-N76D-S78N-S87D-G118R-Y209W-H249R; S24R-N76D-S78N-S87R-G118R-Y209W-M222Q-H249R; N76D-S78N-S87R-G118R-S128L-P129Q-S130A-Y209W; N76D-S78N-S87R-G118R-S128L-P129Q-S130A-Q206L-Y209W; N76D-S87R-S128L-P129Q-S130A-Q206L-Y209W-H249R; N76D-S87R-S128L-P129Q-S130A-Q206L-Y209W; S24R-N76D-S78N-S87D-G118R-Y209W-M222S-H249R; N76D-S78N-S87D-G118R-Y209W-H249R; N76D-S78N-S87D-G118R-Y209W-M222S-H249R; S24R-N76D-S78N-S87D-G118R-M222Q-H249R; N76D-S78N-S87R-G118R-S128L-P129Q-S130A-Q206L-M222S; S3T-N76D-S78N-S87R-G118R-S128L-P129Q-S130A-Q206L; V28T-N76D-S78N-S87R-G118R-S128L-P129Q-S130A-Q206L; N76D-S78N-S87R-A108S-G118R-S128L-P129Q-S130A-Q206L; N76D-S78N-S87R-N116M-G118R-S128L-P129Q-S130A-Q206L; N76D-S78N-S87R-G118R-L124M-S128L-P129Q-S130A-Q206L; N76D-S78N-S87R-G118R-S128L-P129Q-S130A-V150T-Q206L; N76D-S78N-S87R-G118R-S128L-P129Q-S130A-A194D-Q206L; N76D-S78N-S87R-G118R-S128L-P129Q-S130A-A158E-Q206L; V28T-N76D-S78N-S87R-S101F-G118R-S128L-P129Q-S130A-A194D-Q206L; S24R-V28T-N43S-N76D-S78N-S87R-G118R-S128L-P129Q-S130A-A158E-Q206L; S24R-V28T-N76D-S78N-S87R-G118R-S128L-P129Q-S130A-A194D-Q206L; S24R-N76D-S78N-S87D-G118R-S128L-P129Q-S130A-Q206L-T213A; S24R-V28T-N76D-S78N-S87D-S101V-A108S-G118R-S128L-P129Q-S130A-Q206L; S24R-V28T-N76D-S78N-S87D-S101V-N116M-G118R-S128L-P129Q-S130A-A158E-Q206L; S24R-N76D-S78N-S87R-G118R-S128L-P129Q-S130A-Q206L-T213A; N76D-S78N-S87R-S103D-G118R-S128L-P129Q-S130A-Q206L; S24R-V28T-N76D-S78N-S87R-S101V-A108S-G118R-S128L-P129Q-S130A-Q206L-T213A-L217K; S24R-N76D-S78N-S87R-G118R-S128L-P129Q-S130A-Q206L-L217K; S3V-S24R-N76D-S78N-S87R-G100S-S101V-G118R-Q206L-L217K; N76D-N77D-S78N-S87R-G118R-Q206L-T213A; S24R-N76D-S78N-S87D-G100S-S101V-N116M-G118R-L124M-S128L-P129Q-S130A-A194D-Q206L; and S24R-V28T-N76D-S78N-S87R-G118V-S128L-P129Q-S130A-Q206L-T213A-L217K; wherein said variant has proteolytic activity and each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. A still further embodiment is directed to an isolated subtilisin variant comprising a combination of amino acid substitutions selected from: N18R-S87R-G118R-S166N-N204D-Q206L-Y209W; N18R-S24R-L42I-G 118R-Y209W-T213A-M222Q-H249R; N18R-S24R-Y209W-T213A-H249R; N18R-S24R-S87R-G118R-S128L-P129Q-S130A-Q206Y-Y209W-T213A-H249R; S24R-S87D-G118R-Y209W-T213A-H249R; S9G-N18R-S24R-N76D-G118R-S166N-Q206L-H249R; N18R-G118R-Q206L-Y209W-T213A-M222Q-H249R; S24R-S87R-S166N; N18R-S24R-S87R-Q206L-Y209W-T213A; N18R-S24R-G118R-A158V-Y209W; N18R-S24R-S87D-Q206L-Y209W-M222Q-H249R; N18R-S24R-S87R-G127T; S24R-S166N-Y209W-T213A; N76D-S78N-G118R-Y209W-H249R; N18R-N76D-S78N-S87R-Q206L-Y209W-H249R-S259G; N18R-S24R-S87D-N185Y-Q206L-Y209W-T213A-M222Q-H249R; S24R-G118R-G127T-Y209W; A1V-N18R-S24R-S56P-G127T-Q206L-Y209W; S87R-Y209W; N18R-S87D-Y209W-M222Q-H249R; N18R-S24R-G118R-S128L-P129Q-S130A-S166D-Y209W-T213A; S87D-S166D-T213A-H249R; N18R-S24P-S87D-S166N-Q206L-Y209W-M222Q-H249R; N76D-S166N-Y209W-T213A-H249R; S24R-Q206L-Y209W-T213A-M222Q-

H249R; N18R-G118R-Q206L-Y209W; N18R-S24R-S166D-Q206Y-H249R-A254T; N18R-S24R-S78N-Q206L-Y209W-T213A-M222Q-H249R; N18R-S24R-G118R-G127T-Y209W; S24R-N76D-G118R-S166N-Q206L-Y209W; S24R-N76D-S87R-Y209W-T213A-M222Q-H249R; N18K-S87R-Y209W-T213A-M222Q-H249R; N18R-S24R-S87R-Y209W; N18R-S78N-G118R-Y209W-T213A-M222Q-H249R-A270P; N18R-S166N-Y209W-T213A-M222Q; N76D-S78N-S87R-S103P-G118R-S128L-P129Q-S130A-Q206L; N76D-S78N-S87R-G118R-S128L-P129Q-S130A-Q206L-N243S; N76D-S78N-S87R-G118R-S128L-P129Q-S130A-Q206L-H249R; N18R-N76D-S78N-S87R-G118R-S128L-P129Q-S130A-Q206L; N18R-N76D-S78N-S87R-G118R-S128L-P129Q-S130A-Q206L-H249R; N18R-S24R-N76D-S78N-S87R-G118R-S128L-P129Q-S130A-Q206L-H249N; N18R-S24R-N76D-S78N-S87R-S99N-G118R-S128L-P129Q-S130A-A158T-Q206L-I246V-H249R; S24R-N76D-S78N-S128L-P129Q-S130A-Q206L-H249R; N18R-S24R-N76D-S78N-S128L-P129Q-S130A-Q206L-H249R; N76D-S78N-G118R-Q206L-H249R; N18R-I44V-N76D-S78N-S87R-S128L-P129Q-S130A-Q206L-H249R; N18R-N76D-S78N-S87R-Q206L-H249R; N18R-S24R-N76D-S78N-S87R-S128L-P129Q-S130A-Q206L; N76D-S78N-G118R-Q206L; A16T-N18R-S24R-N76D-S78N-G118R-S128L-P129Q-S130A-Q206L; N18R-S24R-N76D-S78N-S87R-G118R-S128L-P129Q-S130A-Q206L-K235T; S24R-N76D-S78N-Q206L-H249R; S24R-N76D-S78N-S87R-S128L-P129Q-S130A-Q206L; N18R-N76D-S78N-S87R-S128L-P129Q-S130A-Q206L; N18R-S24R-N76D-S78N-S128L-P129Q-S130A; S24R-N76D-S78N-H249R; N18R-S24R-N76D-S78N-S87R-G118R-S128L-P129Q-S130A-Q206L-A270T; N18R-S24R-N76D-S78N-G118R-S128L-P129Q-S130A-H249R; N18R-S24R-N76D-S78N-M222Q-H249R; N76D-S78N-S87R-Q206L-H249R; N18R-N76D-S78N-Q206L-H249R; N18R-S24R-N76D-S78N-G118R-Q206L-K251R; N76D-S78N-Q206L-H249R; N18R-S24R-N76D-S78N-S87R-Q206L; N18R-S24R-N76D-S78N-G118R-S128L-P129Q-S130A; N76D-S78N-H120R-Q206L-H249R; N18R-N76D-S78N-S87R-S128L-P129Q-S130A-Q206L-H249R; N18R-G20E-N76D-S78N-G118R-H249R; S24R-N76D-S78N-G118R-S128L-P129Q-S130A; N76D-S78N-G118R-S128L-P129Q-S130A-Q206L-H249R; S24R-N76D-S78N-G118R-Q206L; N18R-N76D-S78N-S128L-P129Q-S130A-Q206L-V268A; N18R-N76D-S78N-S87R-Q206L-N218S-M222Q-H249R; N18R-S24R-N76D-S87R-G118R-S128L-P129Q-S130A-H249R; N76D-S78N-S87R-G118R-S128L-P129Q-S130A; N18R-S24R-N76D-S78N-H249R; N18R-S24R-N76D-S78N-S87R-G118R-S128L-P129Q-S130A-H249R; N18R-S24R-N76D-S78N-S87R-H249R; N76D-S87R-G118R-S128L-P129Q-S130A-Q206L; N76D-S78N-S87R-G118R-S128L-P129Q-S130A-Q206L; N18R-S24R-N76D-S78N-Q206L-H249R; N18R-S24R-N76D-S78N-S87R-G118R-S128L-P129Q-S130A-Q206L-H249R; N76D-S78N-S87R-G118R-S128L-P129Q-S130A-M222Q; S24R-N76D-S87R-Q206Y-T213A-M222Q-H249R; S24R-N76D-S78N-S87D-G118R-Y209W-M222Q-H249R; S87D-Q206L-Y209W-T213A-H249R; S24R-N76D-S78N-S87R-G118R-Q206L-M222Q; S24R-N76D-S78N-Q206L-M222Q; N76D-S78N-S87R-G118R-S128L-P129Q-Q206L-M222Q; N76D-S78N-S87R-G118R-P129Q-Q206L-M222Q; N76D-S78N-S87R-G118R-S130A-Q206L-M222Q; N76D-S78N-S87R-G118R-S128L-P129Q-Q206L; N76D-S78N-S87R-G118R-S128L-S130A-Q206L; N76D-S78N-S87R-G118R-S128L-Q206L; N76D-S78N-S87R-G118R-P129Q-Q206L; N76D-S78N-S87R-G118R-S130A-Q206L; N76D-S78N-S87R-G118R-Q206L-M222Q; N76D-S78N-S87R-G118R-Q206L; S24R-N76D-S78N-S87R-G118R-Y209W-M222Q; S24R-N43R-N76D-S78N-S87R-G118R-Y209W-M222Q; G20R-S24R-N43R-N76D-S78N-S87R-G118R-Y209W-M222Q; G20R-N43R-N76D-S78N-S87R-G118R-Y209W-M222Q; S24R-N76D-S78N-S87R-G118R-Q206L-Y209W-T213A-M222Q; S24R-N76D-S78N-S87R-G118R-Q206L-T213A-M222Q; S24R-N76D-S78N-S87R-G118R-Y209W-T213A-M222Q; S24R-N76D-S78N-S87R-N116L-G118R-Y209W-M222Q; G20R-S24R-N43R-N76D-S78N-S87R-N116L-G118R-Y209W-M222Q; N18R-N76D-S87R-S128L-P129Q-S130A-Q206L-Y209W-H249R; N18R-S87D-S166N-Q206L-Y209W; N18R-S24R-N76D-S78N-S87R-G118R-G127T-Y209W-T213A; N18R-S24R-S166D-Q206Y-H249R; S24R-S78N-S87R-S166D-Q206L-Y209W-H249R; S3V-N76D-S78N-S87R-G118R-S128L-P129Q-S130A-Q206L; N76D-S78N-S87R-S101V-G118R-S128L-P129Q-S130A-Q206L; N76D-S78N-S87R-G118R-G127T-S128L-P129Q-S130A-Q206L; N76D-S78N-S87R-S101G-S103A-V104I-G118R-Q206L; N76D-S78N-S87R-G118R-G127T-Q206L; N76D-S78N-S87R-G118R-G127T-P129Q-Q206L; N76D-S78N-S87R-G118R-G127T-P129Q-S130A-Q206L; N76D-S78N-S87R-S101G-S103A-V104I-G118R-G127T-P129R-Q206L; N76D-S78N-S87R-G118R-S128L-P129Q-S130A-Q206L-S212D; N76D-S78N-S87R-G118R-S128L-P129Q-S130A-S166D-Q206L; S3V-N76D-S78N-S87R-S101G-S103A-V104I-G118R-S128L-P129Q-S130A-Q206L; N76D-S78N-S87R-G118R-S128L-P129Q-S130A-Q206L-T213A; N76D-S78N-S87R-G118R-S128L-P129Q-S130A-Q206L-A232V-Q245R; N76D-S78N-S87R-G118R-S128L-P129Q-S130A-G159D-S188D-Q206L-A232V-Q245R; S3V-S24R-N76D-S78N-S87D-G118R-Y209W-M222Q-H249R; S24R-N76D-S78N-S87D-S101V-G118R-Y209W-M222Q-H249R; S24R-N76D-S78N-S87D-S101G-S103A-V104I-G118R-Y209W-M222Q-H249R; S24R-N76D-S78N-S87D-G118R-Y209W-M222Q-H249R-S212D; S3V-S24R-N76D-S78N-S87D-S101G-S103A-V104I-G118R-Y209W-M222Q-H249R; S24R-N76D-S78N-S87D-S101G-S103A-V104I-G118R-G127T-Y209W-T213A-M222Q-H249R; S024R-N074D-S76N-S085D-S0 99G-S101A-V102I-G116R-Y203W-M216Q-A226V-Q239R-H243R; S24R-N76D-S78N-S87D-S101G-S103A-V104I-G118R-Y209W-H249R; S3V-S24R-N76D-S78N-S87D-S101G-S103A-V104I-G118R-Y209W-H249R; S24R-N76D-S78N-S87D-S101G-S103A-V104I-G118R-G127T-Y209W-T213A-H249R; S24R-N76D-S78N-S87D-S101T-G118R-Y209W-M222Q-H249R; S24R-N76D-S78N-S87D-S101H-G118R-Y209W-M222Q-H249R; S24R-N76D-S78N-S87D-G118R-P129Q-Y209W-M222Q-H249R; N76D-S78N-S87D-G118R-S128L-P129Q-S130A-Q206L; S24R-N76D-S78N-S87R-G118R-S128L-P129Q-S130A-Q206L-H249R; N18R-S24R-N76D-S78N-S87R-G118R-S128L-P129Q-S130A-Q206L; S24R-N76D-S78N-S87R-G118R-S128L-P129Q-S130A-Q206L; S24R-N76D-S78N-S87D-G118R-Y209W-H249R; S24R-N76D-S78N-S87R-G118R-Y209W-M222Q-H249R; N76D-S78N-S87R-G118R-S128L-P129Q-S130A-Y209W; N76D-S78N-S87R-G118R-S128L-P129Q-S130A-Q206L-Y209W; N76D-S87R-S128L-P129Q-S130A-Q206L-Y209W-H249R; N76D-S87R-S128L-P129Q-S130A-Q206L-Y209W; S24R-N76D-S78N-S87D-G118R-Y209W-M222S-H249R; N76D-S78N-S87D-G118R-Y209W-H249R; N76D-S78N-S87D-G118R-Y209W-M222S-H249R; S24R-N76D-S78N-S87D-G118R-M222Q-H249R; N76D-S78N-S87R-G118R-S128L-P129Q-S130A-Q206L-M222S; S3T-N76D-S78N-S87R-G118R-S128L-P129Q-S130A-Q206L; V28T-N76D-S78N-S87R-G118R-S128L-P129Q-S130A-Q206L; N76D-S78N-

S87R-A108S-G118R-S128L-P129Q-S130A-Q206L;
N76D-S78N-S87R-N116M-G118R-S128L-P129Q-S130A-Q206L; N76D-S78N-S87R-G118R-L124M-S128L-P129Q-S130A-Q206L; N76D-S78N-S87R-G118R-S128L-P129Q-S130A-V150T-Q206L; N76D-S78N-S87R-G118R-S128L-P129Q-S130A-A194D-Q206L; N76D-S78N-S87R-G118R-S128L-P129Q-S130A-A158E-Q206L; V28T-N76D-S78N-S87R-S101F-G118R-S128L-P129Q-S130A-A194D-Q206L; S24R-V28T-N43S-N76D-S78N-S87R-G118R-S128L-P129Q-S130A-A158E-Q206L; S24R-V28T-N76D-S78N-S87R-G118R-S128L-P129Q-S130A-A194D-Q206L; S24R-N76D-S78N-S87D-G118R-S128L-P129Q-S130A-Q206L-T213A; S24R-V28T-N76D-S78N-S87D-S101V-A108S-G118R-S128L-P129Q-S130A-Q206L; S24R-V28T-N76D-S78N-S87D-S101V-N116M-G118R-S128L-P129Q-S130A-A158E-Q206L; S24R-N76D-S78N-S87R-G118R-S128L-P129Q-S130A-Q206L-T213A; N76D-S78N-S87R-S103D-G118R-S128L-P129Q-S130A-Q206L; S24R-V28T-N76D-S78N-S87R-S101V-A108S-G118R-S128L-P129Q-S130A-Q206L-T213A-L217K; S24R-N76D-S78N-S87R-G118R-S128L-P129Q-S130A-Q206L-L217K; S3V-S24R-N76D-S78N-S87R-G100S-S101V-G118R-Q206L-L217K; N76D-N77D-S78N-S87R-G118R-Q206L-T213A; S24R-N76D-S78N-S87D-G100S-S101V-N116M-G118R-L124M-S128L-P129Q-S130A-A194D-Q206L; S24R-V28T-N76D-S78N-S87R-G118V-S128L-P129Q-S130A-Q206L-T213A-L217K; S3V-N76D-S78N-S87R-G118R-S128L-P129Q-S130A; S3V-N76D-S78N-S87R-G118R-S128L-P129Q-S130A-Y209W; N76D-S78G-S87R-G118R-S128L-P129Q-S130A-Q206F; N76D-S78G-S87R-G118R-S128L-P129Q-S130A-Q206Y; S3V-N76D-S78G-S87R-G118R-S128L-P129Q-S130A-Q206F; S3V-N76D-S78G-S87R-G118R-S128L-P129Q-S130A-Q206M; S3V-N76D-S78G-S87R-G118R-S128L-P129Q-S130A-Q206Y; N76D-S78N-S87R-G118R-S128L-P129Q-S130A-Q206F; N76D-S78N-S87R-G118R-S128L-P129Q-S130A-Q206M; N76D-S78N-S87R-G118R-S128L-P129Q-S130A-Q206Y; S3V-N76D-S78N-S87R-G118R-S128L-P129Q-S130A-Q206F; S3V-N76D-S78N-S87R-G118R-S128L-P129Q-S130A-Q206M; S3V-N76D-S78N-S87R-G118R-S128L-P129Q-S130A-Q206Y; P40E-N76D-S87R-G118R-S128L-P129Q-S130A; 18V-P40E-N76D-S87R-G118R-S128L-P129Q-S130A; P40E-N76D-S87R-G118R-S128L-P129Q-S130A-P210I; P40E-N76D-S87R-G118R-S128L-P129Q-S130A-G211P; P40E-N76D-S87R-G118R-S128L-P129Q-S130A-N261I; N76D-S78N-S87R-G118R-S128L-P129Q-S130A-P210I; N76D-S78N-S87R-G118R-S128L-P129Q-S130A-Y209W-L262Q; N76D-S78N-S87R-G118R-S128L-P129Q-S130A-P210I-L262Q; N76D-S78N-S87R-G118R-S128L-P129Q-S130A-V147I-A194P-A215V-E271D; T22W-N76D-S78N-S87R-G118R-S128L-P129Q-S130A-V147I-A194P-A215V; T22W-N76D-S78N-S87R-G118R-S128L-P129Q-S130A-V147I-A215V-E271D; N76D-S87R-G118R-S128L-P129Q-S130A-L217K; N76D-S78N-S87R-G118R-S128L-P129Q-S130A-L217K; N76D-S78N-S87R-G118R-S128L-P129Q-S130A-V150T; N76D-S78G-S87R-G118R-S128L-P129Q-S130A-P210L; N76D-S87R-E89H-G118R-S128L-P129Q-S130A-Q206Y; S3V-N76D-S87R-E89H-G118R-S128L-P129Q-S130A-P210L; N76D-S78Q-S87R-G118R-S128L-P129Q-S130A-Q206D; N76D-S78T-S87R-G118R-S128L-P129Q-S130A-Q206D; N76D-S78V-S87R-G118R-S128L-P129Q-S130A-Q206D; N76D-S78W-S87R-G118R-S128L-P129Q-S130A-Q206D; N76D-S78Y-S87R-G118R-S128L-P129Q-S130A-Q206D; N76D-S78A-S87R-G118R-S128L-P129Q-S130A-Q206F; N76D-S78C-S87R-G118R-S128L-P129Q-S130A-Q206F; N76D-S78E-S87R-G118R-S128L-P129Q-S130A-Q206F; N76D-S78F-S87R-G118R-S128L-P129Q-S130A-Q206F; N76D-S78H-S87R-G118R-S128L-P129Q-S130A-Q206F; N76D-S78K-S87R-G118R-S128L-P129Q-S130A-Q206F; N76D-S78L-S87R-G118R-S128L-P129Q-S130A-Q206F; N76D-S78M-S87R-G118R-S128L-P129Q-S130A-Q206F; N76D-S78Q-S87R-G118R-S128L-P129Q-S130A-Q206F; N76D-S78T-S87R-G118R-S128L-P129Q-S130A-Q206F; N76D-S78W-S87R-G118R-S128L-P129Q-S130A-Q206F; N76D-S78Y-S87R-G118R-S128L-P129Q-S130A-Q206F; N76D-S78C-S87R-G118R-S128L-P129Q-S130A-Q206G; N76D-S78M-S87R-G118R-S128L-P129Q-S130A-Q206G; N76D-S78C-S87R-G118R-S128L-P129Q-S130A-Q206H; N76D-S78E-S87R-G118R-S128L-P129Q-S130A-Q206H; N76D-S78F-S87R-G118R-S128L-P129Q-S130A-Q206H; N76D-S78G-S87R-G118R-S128L-P129Q-S130A-Q206H; N76D-S78H-S87R-G118R-S128L-P129Q-S130A-Q206H; N76D-S78L-S87R-G118R-S128L-P129Q-S130A-Q206H; N76D-S78T-S87R-G118R-S128L-P129Q-S130A-Q206H; N76D-S78V-S87R-G118R-S128L-P129Q-S130A-Q206H; N76D-S78A-S87R-G118R-S128L-P129Q-S130A-Q206M; N76D-S78C-S87R-G118R-S128L-P129Q-S130A-Q206M; N76D-S78E-S87R-G118R-S128L-P129Q-S130A-Q206M; N76D-S78F-S87R-G118R-S128L-P129Q-S130A-Q206M; N76D-S78G-S87R-G118R-S128L-P129Q-S130A-Q206M; N76D-S78I-S87R-G118R-S128L-P129Q-S130A-Q206M; N76D-S78K-S87R-G118R-S128L-P129Q-S130A-Q206M; N76D-S78L-S87R-G118R-S128L-P129Q-S130A-Q206M; N76D-S78M-S87R-G118R-S128L-P129Q-S130A-Q206M; N76D-S78Q-S87R-G118R-S128L-P129Q-S130A-Q206M; N76D-S78R-S87R-G118R-S128L-P129Q-S130A-Q206M; N76D-S78T-S87R-G118R-S128L-P129Q-S130A-Q206M; N76D-S78V-S87R-G118R-S128L-P129Q-S130A-Q206M; N76D-S78Y-S87R-G118R-S128L-P129Q-S130A-Q206M; N76D-S78A-S87R-G118R-S128L-P129Q-S130A-Q206N; N76D-S78C-S87R-G118R-S128L-P129Q-S130A-Q206N; N76D-S78E-S87R-G118R-S128L-P129Q-S130A-Q206N; N76D-S78G-S87R-G118R-S128L-P129Q-S130A-Q206N; N76D-S78H-S87R-G118R-S128L-P129Q-S130A-Q206N; N76D-S78I-S87R-G118R-S128L-P129Q-S130A-Q206N; N76D-S78L-S87R-G118R-S128L-P129Q-S130A-Q206N; N76D-S78M-S87R-G118R-S128L-P129Q-S130A-Q206N; N76D-S78Q-S87R-G118R-S128L-P129Q-S130A-Q206N; N76D-S78R-S87R-G118R-S128L-P129Q-S130A-Q206P; N76D-S78W-S87R-G118R-S128L-P129Q-S130A-Q206P; N76D-S78A-S87R-G118R-S128L-P129Q-S130A-Q206R; N76D-S78C-S87R-G118R-S128L-P129Q-S130A-Q206R; N76D-S78E-S87R-G118R-S128L-P129Q-S130A-Q206R; N76D-S78F-S87R-G118R-S128L-P129Q-S130A-Q206R; N76D-S78G-S87R-G118R-S128L-P129Q-S130A-Q206R; N76D-S78H-S87R-G118R-S128L-P129Q-S130A-Q206R; N76D-S78I-S87R-G118R-S128L-P129Q-S130A-Q206R; N76D-S78L-S87R-G118R-S128L-P129Q-S130A-Q206R; N76D-S78M-S87R-G118R-S128L-P129Q-S130A-Q206R; N76D-S78P-S87R-G118R-S128L-P129Q-S130A-Q206R; N76D-S78Q-S87R-G118R-S128L-P129Q-S130A-Q206R; N76D-S78R-S87R-G118R-S128L-P129Q-S130A-Q206R; N76D-S78T-S87R-G118R-S128L-P129Q-S130A-Q206R; N76D-S78V-S87R-G118R-S128L-P129Q-S130A-Q206R; N76D-S78C-S87R-G118R-S128L-P129Q-S130A-Q206S; N76D-S78E-S87R-G118R-S128L-P129Q-S130A-Q206S; N76D-S78H-S87R-G118R-S128L-P129Q-S130A-Q206S; N76D-S78M-S87R-G118R-S128L-P129Q-S130A-Q206S; N76D-S78W-S87R-G118R-S128L-P129Q-S130A-Q206S; N76D-S78C-S87R-G118R-S128L-P129Q-S130A-Q206Y; N76D-S78E-S87R-G118R-S128L-P129Q-S130A-Q206Y; N76D-S78H-S87R-G118R-S128L-P129Q-S130A-Q206Y; N76D-S78I-S87R-G118R-S128L-P129Q-S130A-Q206Y;

N76D-S78K-S87R-G118R-S128L-P129Q-S130A-Q206Y;
N76D-S78L-S87R-G118R-S128L-P129Q-S130A-Q206Y;
N76D-S78M-S87R-G118R-S128L-P129Q-S130A-Q206Y;
N76D-S78N-S87R-G118R-S128L-P129Q-S130A-Q206Y;
N76D-S78R-S87R-G118R-S128L-P129Q-S130A-Q206Y;
N76D-S78T-S87R-G118R-S128L-P129Q-S130A-Q206Y;
N76D-S78W-S87R-G118R-S128L-P129Q-S130A-Q206Y;
N76D-S78Y-S87R-G118R-S128L-P129Q-S130A-Q206Y;
N76D-S78H-S87R-G118R-S128L-P129Q-S130A-Q206A;
N76D-S78H-S87R-G118R-S128L-P129Q-S130A-Q206D;
N76D-S78I-S87R-G118R-S128L-P129Q-S130A-Q206D;
N76D-S78L-S87R-G118R-S128L-P129Q-S130A-Q206D;
N76D-S78P-S87R-G118R-S128L-P129Q-S130A-Q206D;
N76D-S78C-S87R-G118R-S128L-P129Q-S130A-Q206A;
N76D-S78Q-S87R-G118R-S128L-P129Q-S130A-Q206A;
N76D-S78A-S87R-G118R-S128L-P129Q-S130A-Q206D;
N76D-S78C-S87R-G118R-S128L-P129Q-S130A-Q206D;
N76D-S78E-S87R-G118R-S128L-P129Q-S130A-Q206D;
N76D-S78G-S87R-G118R-S128L-P129Q-S130A-Q206D;
N76D-S78M-S87R-G118R-S128L-P129Q-S130A-Q206D;
N76D-S78M-S87R-G118R-S128L-P129Q-S130A-Q206H;
N76D-S78A-S87R-G118R-S128L-P129Q-S130A-Q206H;
N76D-S78H-S87R-G118R-S128L-P129Q-S130A-Q206M;
S3V-S24R-N76D-S78N-S87D-G118R-Y209W-H249R;
S3V-N76D-S78N-S87D-G118R-Y209W-H249R; S3I-N43Y-L82D-G127S-S216Y-L217K-S256P; G127S-S216Y;
S3V-18V-P40E-N76D-S87D-G118R-S128R-A215K-N261I; S3V-I8V-P40E-N76D-G118R-S128R-P210I-N261I;
S3V-P40E-N76D-S87D-G118R-S128R-P210I-L217K;
S3V-N76D-G118R-S128R; S3V-N76D-S87D-G118R-S128R; S3V-N76D-G118R-S128R-P210I; S3V-N76D-G118R-S128R-N261I; S3V-P40E-N76D-G118R; S3V-P40E-N76D-G118R-S128R; S3V-I8V-P40E-N76D-G118R-S128R; S3V-P40E-N76D-S87D-G118R-S128R; S3V-P40E-N76D-G118R-S128R-S160Q; S3V-P40E-N76D-G118R-S128R-P210I; S3V-P40E-N76D-G118R-S128R-G211P; S3V-P40E-N76D-G118R-S128R-A215K; S3V-P40E-N76D-G118R-S128R-L217K; S3V-P40E-N76D-G118R-S128R-N261I; S3V-P40E-N76D-G118R-S128R-L262Q; S3V-18V-P40E-N76D-G118R; S3V-P40E-N76D-S87D-G118R; S3V-P40E-N76D-G118R-S160Q; S3V-P40E-N76D-G118R-Q206Y; S3V-P40E-N76D-G118R-P210I; S3V-P40E-N76D-G118R-G211P; S3V-P40E-N76D-G118R-A215; S3V-P40E-N76D-G118R-L217K; S3V-P40E-N76D-G118R-N261I; S3V-P40E-N76D-G118R-L262Q; S3V-N76D-G118R-S128R-G211P; S3V-N76D-G118R-S128R-L262Q; T22W-N76D-S78N-S87R-G118R-S128R-P129Q-S130A-V147I-A194P-A215V-E271D;
N76D-S78N-S87R-G118R-S128R-P129Q-S130A; N76D-S78N-S87R-G118R-S128R-P129Q-S130A-V147I-A194P-A215V; N76D-S78N-S87R-G118R-S128R-P129Q-S130A-V147I-A194P-E271D; T22W-N76D-S78N-S87R-G118R-S128R-P129Q-S130A-A215V-E271D; T22W-N76D-S78N-S87R-G118R-S128R-P129Q-S130A-A194P-E271D; P40E-N76D-S78G-G118R-S128R-Q206Y-L262Q; S3V-P40E-N76D-G118R-G211P-L217K-N261I; I8V-P40E-N76D-S78G-G118R-Q206Y-L217K; S3V-18V-N76D-S78G-S87D-G118R-P210I-A215K-N252I; S3V-P40E-N76D-G118R-S160Q-P210I-L217K-N261I; I8V-N76D-S78G-G118R-S160Q-Q206Y-N252I-N261I; I8V-P40E-N76D-G118R-P210I-A215K-N261I; I8V-P40E-N76D-S78G-G118R-Q206Y-P210I-A215K-N261I; S3V-N76D-G118R-S160Q-G211P-A215V-L262Q; S3V-N76D-S87D-G118R-S128R-G211P-N261I-L262Q; S3V-P40E-N76D-G118R-Q206Y-P210I-G211P-A215K-N261I; I8V-P40E-N76D-S78G-G118R-G211P-L217K-N252I-N261I; S3V-P40E-N76D-S87D-G118R-S128R-P210I-L217K-N261I;
S3V-P40E-N76D-G118R-S160Q-P210I-W241K-L262Q; I8V-N76D-S78G-G118R-P210I-A215V-N261I; N76D-S78G-S87D-G118R-P210I-A215V-L217K-N261I-L262Q; S3V-P40E-N76D-S78G-G118R-Q206Y-L217K; S3V-P40E-N76D-S78G-G118R-S128L-P129Q-S130A-L217K; S3V-P40E-N76D-S78G-G118R-S128L-P129Q-S130A-Q206Y-P210I-A215V-L217K; N76D-S78N-S87D-G118R-S128L-P129Q-S130A-Q206Y; S3V-P40E-N76D-S78G-G118R-S128L-P129Q-S130A-A215K-N261I; S3V-N76D-S87D-G118R-S128L-P129Q-S130A-P210I-L217K; N76D-S87R-G118R-S128K-V150T-L217K; N76D-S78N-S87R-G118R-S128K-V150T-L217K; N76D-S78N-S87R-G118R-S128K-V150T; S3V-N76D-S78G-S87D-G118A-S166N-A194P-Q206M-P210I-N218S-N248D-N261I-L262Q; S3V-N76D-S78G-S87T-S101Q-G118A-S130Q-S166N-A194P-P210I-N218S-N248D-S256P-N261I; S3V-N76D-S78G-S87D-S101Q-G118A-Q206M-P210I-L217K-N218S-M222Q-N248D-S256P; and S24L-N76D-S78N-S87D-A88S-G118R-Q206Y-Y209W-H249R, wherein said variant has proteolytic activity and each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence.

A yet still further embodiment is directed to an isolated subtilisin variant comprising a combination of amino acid substitutions selected from: N76D-S78N-S87R-S103P-G118R-S128L-P129Q-S130A-Q206L; N76D-S78N-S87R-G118R-S128L-P129Q-S130A-Q206L-N243S; N76D-S78N-S87R-G118R-S128L-P129Q-S130A-Q206L-H249R; N18R-N76D-S78N-S87R-G118R-S128L-P129Q-S130A-Q206L; N18R-N76D-S78N-S87R-G118R-S128L-P129Q-S130A-Q206L-H249R; N18R-S24R-N76D-S78N-S87R-G118R-S128L-P129Q-S130A-Q206L-H249N; N18R-S24R-N76D-S78N-S87R-S99N-G118R-S128L-P129Q-S130A-A158T-Q206L-I246V-H249R; N18R-S24R-N76D-S78N-S87R-G118R-S128L-P129Q-S130A-Q206L-K235T; N18R-S24R-N76D-S78N-S87R-G118R-S128L-P129Q-S130A-Q206L-A270T; N18R-S24R-N76D-S87R-G118R-S128L-P129Q-S130A-H249R; N76D-S78N-S87R-G118R-S128L-P129Q-S130A; N18R-S24R-N76D-S78N-S87R-G118R-S128L-P129Q-S130A-H249R; N76D-S78R-G118R-S128L-P129Q-S130A-Q206L; N76D-S78N-S87R-G118R-S128L-P129Q-S130A-Q206L; N18R-S24R-N76D-S78N-S87R-G118R-S128L-P129Q-S130A-Q206L-H249R; N76D-S78N-S87R-G118R-S128L-P129Q-S130A-M222Q; S3V-N76D-S78N-S87R-G118R-S128L-P129Q-S130A-Q206L; N76D-S78N-S87R-S101V-G118R-S128L-P129Q-S130A-Q206L; N76D-S78N-S87R-G118R-G127T-S128L-P129Q-S130A-Q206L; N76D-S78N-S87R-G118R-S128L-P129Q-S130A-Q206L-S212D; N76D-S78N-S87R-G118R-S128L-P129Q-S130A-S166D-Q206L; S3V-N76D-S78N-S87R-S101G-S103A-V104I-G118R-S128L-P129Q-S130A-Q206L; N76D-S78N-S87R-G118R-S128L-P129Q-S130A-Q206L-T213A; N76D-S78N-S87R-G118R-S128L-P129Q-S130A-Q206L-A232V-Q245R; N76D-S78N-S87R-G118R-S128L-P129Q-S130A-G159D-S188D-Q206L-A232V-Q245R; S24R-N76D-S78N-S87R-G118R-S128L-P129Q-S130A-Q206L-H249R; N18R-S24R-N76D-S78N-S87R-G118R-S128L-P129Q-S130A-Q206L; S24R-N76D-S78N-S87R-G118R-S128L-P129Q-S130A-Q206L; N76D-S78N-S87R-G118R-S128L-P129Q-S130A-Y209W; N76D-S78N-S87R-G118R-S128L-P129Q-S130A-Q206L-Y209W; N76D-S78N-S87R-G118R-S128L-P129Q-S130A-Q206L-M222S; S3T-N76D-S78N-S87R-G118R-S128L-P129Q-S130A-Q206L; V28T-N76D-S78N-S87R-G118R-

S128L-P129Q-S130A-Q206L; N76D-S78N-S87R-A108S-G118R-S128L-P129Q-S130A-Q206L; N76D-S78N-S87R-N116M-G118R-S128L-P129Q-S130A-Q206L; N76D-S78N-S87R-G118R-L124M-S128L-P129Q-S130A-Q206L; N76D-S78N-S87R-G118R-S128L-P129Q-S130A-V150T-Q206L; N76D-S78N-S87R-G118R-S128L-P129Q-S130A-A194D-Q206L; N76D-S78N-S87R-G118R-S128L-P129Q-S130A-A158E-Q206L; V28T-N76D-S78N-S87R-S101F-G118R-S128L-P129Q-S130A-A194D-Q206L; S24R-V28T-N43S-N76D-S78N-S87R-G118R-S128L-P129Q-S130A-A158E-Q206L; S24R-V28T-N76D-S78N-S87R-G118R-S128L-P129Q-S130A-A194D-Q206L; S24R-N76D-S78N-S87R-G118R-S128L-P129Q-S130A-Q206L-T213A; N76D-S78N-S87R-S103D-G118R-S128L-P129Q-S130A-Q206L; S24R-V28T-N76D-S78N-S87R-S101V-A108S-G118R-S128L-P129Q-S130A-Q206L-T213A-L217K; and S24R-N76D-S78N-S87R-G118R-S128L-P129Q-S130A-Q206L-L217K; wherein said variant has proteolytic activity and each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. An even yet still further embodiment is directed to an isolated subtilisin variant comprising a combination of amino acid substitutions selected from: N76D-S78N-S87R-S103P-G118R-S128L-P129Q-S130A-Q206L; N76D-S78N-S87R-G118R-S128L-P129Q-S130A-Q206L-N243S; N76D-S78N-S87R-G118R-S128L-P129Q-S130A-Q206L-H249R; N18R-N76D-S78N-S87R-G118R-S128L-P129Q-S130A-Q206L; N18R-N76D-S78N-S87R-G118R-S128L-P129Q-S130A-Q206L-H249R; N18R-S24R-N76D-S78N-S87R-G118R-S128L-P129Q-S130A-Q206L-H249N; N18R-S24R-N76D-S78N-S87R-S99N-G118R-S128L-P129Q-S130A-A158T-Q206L-I246V-H249R; N18R-S24R-N76D-S78N-S87R-G118R-S128L-P129Q-S130A-Q206L-K235T; N18R-S24R-N76D-S78N-S87R-G118R-S128L-P129Q-S130A-Q206L-A270T; N18R-S24R-N76D-S87R-G118R-S128L-P129Q-S130A-H249R; N76D-S78N-S87R-G118R-S128L-P129Q-S130A; N18R-S24R-N76D-S78N-S87R-G118R-S128L-P129Q-S130A-H249R; N76D-S87R-G118R-S128L-P129Q-S130A-Q206L; N76D-S78N-S87R-G118R-S128L-P129Q-S130A-Q206L; N18R-S24R-N76D-S78N-S87R-G118R-S128L-P129Q-S130A-Q206L-H249R; N76D-S78N-S87R-G118R-S128L-P129Q-S130A-M222Q; S3V-N76D-S78N-S87R-G118R-S128L-P129Q-S130A-Q206L; N76D-S78N-S87R-S101V-G118R-S128L-P129Q-S130A-Q206L; N76D-S78N-S87R-G118R-G127T-S128L-P129Q-S130A-Q206L; N76D-S78N-S87R-G118R-S128L-P129Q-S130A-Q206L-S212D; N76D-S78N-S87R-G118R-S128L-P129Q-S130A-S166D-Q206L; S3V-N76D-S78N-S87R-S101G-S103A-V104I-G118R-S128L-P129Q-S130A-Q206L; N76D-S78N-S87R-G118R-S128L-P129Q-S130A-Q206L-T213A; N76D-S78N-S87R-G118R-S128L-P129Q-S130A-Q206L-A232V-Q245R; N76D-S78N-S87R-G118R-S128L-P129Q-S130A-G159D-S188D-Q206L-A232V-Q245R; S24R-N76D-S78N-S87R-G118R-S128L-P129Q-S130A-Q206L-H249R; N18R-S24R-N76D-S78N-S87R-G118R-S128L-P129Q-S130A-Q206L; S24R-N76D-S78N-S87R-G118R-S128L-P129Q-S130A-Q206L; N76D-S78N-S87R-G118R-S128L-P129Q-S130A-Y209W; N76D-S78N-S87R-G118R-S128L-P129Q-S130A-Q206L-Y209W; N76D-S78N-S87R-G118R-S128L-P129Q-S130A-Q206L-M222S; S3T-N76D-S78N-S87R-G118R-S128L-P129Q-S130A-Q206L; V28T-N76D-S78N-S87R-G118R-S128L-P129Q-S130A-Q206L; N76D-S78N-S87R-A108S-G118R-S128L-P129Q-S130A-Q206L; N76D-S78N-S87R-N116M-G118R-S128L-P129Q-S130A-Q206L; N76D-S78N-S87R-G118R-L124M-S128L-P129Q-S130A-Q206L; N76D-S78N-S87R-G118R-S128L-P129Q-S130A-V150T-Q206L; N76D-S78N-S87R-G118R-S128L-P129Q-S130A-A194D-Q206L; N76D-S78N-S87R-G118R-S128L-P129Q-S130A-A158E-Q206L; V28T-N76D-S78N-S87R-S101F-G118R-S128L-P129Q-S130A-A194D-Q206L; S24R-V28T-N43S-N76D-S78N-S87R-G118R-S128L-P129Q-S130A-A158E-Q206L; S24R-V28T-N76D-S78N-S87R-G118R-S128L-P129Q-S130A-A194D-Q206L; S24R-N76D-S78N-S87R-G118R-S128L-P129Q-S130A-Q206L-T213A; N76D-S78N-S87R-S103D-G118R-S128L-P129Q-S130A-Q206L; S24R-V28T-N76D-S78N-S87R-S101V-A108S-G118R-S128L-P129Q-S130A-Q206L-T213A-L217K; S24R-N76D-S78N-S87R-G118R-S128L-P129Q-S130A-Q206L-L217K; S3V-N76D-S78N-S87R-G118R-S128L-P129Q-S130A; S3V-N76D-S78N-S87R-G118R-S128L-P129Q-S130A-Y209W; N76D-S78G-S87R-G118R-S128L-P129Q-S130A-Q206F; N76D-S78G-S87R-G118R-S128L-P129Q-S130A-Q206Y; S3V-N76D-S78G-S87R-G118R-S128L-P129Q-S130A-Q206F; S3V-N76D-S78G-S87R-G118R-S128L-P129Q-S130A-Q206M; S3V-N76D-S78G-S87R-G118R-S128L-P129Q-S130A-Q206; N76D-S78N-S87R-G118R-S128L-P129Q-S130A-Q206F; N76D-S78N-S87R-G118R-S128L-P129Q-S130A-Q206M; N76D-S78N-S87R-G118R-S128L-P129Q-S130A-Q206Y; S3V-N76D-S78N-S87R-G118R-S128L-P129Q-S130A-Q206F; S3V-N76D-S78N-S87R-G118R-S128L-P129Q-S130A-Q206M; S3V-N76D-S78N-S87R-G118R-S128L-P129Q-S130A-Q206Y; P40E-N76D-S87R-G118R-S128L-P129Q-S130A; 18V-P40E-N76D-S87R-G118R-S128L-P129Q-S130A; P40E-N76D-S87R-G118R-S128L-P129Q-S130A-P210I; P40E-N76D-S87R-G118R-S128L-P129Q-S130A-G211P; P40E-N76D-S87R-G118R-S128L-P129Q-S130A-N261I; N76D-S78N-S87R-G118R-S128L-P129Q-S130A-P210I; N76D-S78N-S87R-G118R-S128L-P129Q-S130A-Y209W-L262Q; N76D-S78N-S87R-G118R-S128L-P129Q-S130A-P210I-L262Q; N76D-S78N-S87R-G118R-S128L-P129Q-S130A-V147I-A194P-A215V-E271D; T22W-N76D-S78N-S87R-G118R-S128L-P129Q-S130A-V147I-A194P-A215V; T22W-N76D-S78N-S87R-G118R-S128L-P129Q-S130A-V147I-A215V-E271D; N76D-S87R-G118R-S128L-P129Q-S130A-L217K; N76D-S78N-S87R-G118R-S128L-P129Q-S130A-L217K; N76D-S78N-S87R-G118R-S128L-P129Q-S130A-V150T; N76D-S78G-S87R-G118R-S128L-P129Q-S130A-P210L; N76D-S87R-E89H-G118R-S128L-P129Q-S130A-Q206Y; S3V-N76D-S87R-E89H-G118R-S128L-P129Q-S130A-P210L; N76D-S78Q-S87R-G118R-S128L-P129Q-S130A-Q206D; N76D-S78T-S87R-G118R-S128L-P129Q-S130A-Q206D; N76D-S78V-S87R-G118R-S128L-P129Q-S130A-Q206D; N76D-S78W-S87R-G118R-S128L-P129Q-S130A-Q206D; N76D-S78Y-S87R-G118R-S128L-P129Q-S130A-Q206D; N76D-S78A-S87R-G118R-S128L-P129Q-S130A-Q206F; N76D-S78C-S87R-G118R-S128L-P129Q-S130A-Q206F; N76D-S78E-S87R-G118R-S128L-P129Q-S130A-Q206F; N76D-S78F-S87R-G118R-S128L-P129Q-S130A-Q206F; N76D-S78H-S87R-G118R-S128L-P129Q-S130A-Q206F; N76D-S78K-S87R-G118R-S128L-P129Q-S130A-Q206F; N76D-S78L-S87R-G118R-S128L-P129Q-S130A-Q206F; N76D-S78M-S87R-G118R-S128L-P129Q-S130A-Q206F; N76D-S78Q-S87R-G118R-S128L-P129Q-S130A-Q206F; N76D-S78T-S87R-G118R-S128L-P129Q-S130A-Q206F; N76D-S78W-S87R-G118R-S128L-P129Q-S130A-Q206F; N76D-S78Y-S87R-G118R-S128L-P129Q-S130A-Q206F; N76D-S78C-S87R-G118R-S128L-P129Q-S130A-Q206G; N76D-S78M-S87R-

G118R-S128L-P129Q-S130A-Q206G; N76D-S78C-S87R-G118R-S128L-P129Q-S130A-Q206H; N76D-S78E-S87R-G118R-S128L-P129Q-S130A-Q206H; N76D-S78F-S87R-G118R-S128L-P129Q-S130A-Q206H; N76D-S78G-S87R-G118R-S128L-P129Q-S130A-Q206H; N76D-S78H-S87R-G118R-S128L-P129Q-S130A-Q206H; N76D-S78L-S87R-G118R-S128L-P129Q-S130A-Q206H; N76D-S78T-S87R-G118R-S128L-P129Q-S130A-Q206H; N76D-S78V-S87R-G118R-S128L-P129Q-S130A-Q206H; N76D-S78A-S87R-G118R-S128L-P129Q-S130A-Q206M; N76D-S78C-S87R-G118R-S128L-P129Q-S130A-Q206M; N76D-S78E-S87R-G118R-S128L-P129Q-S130A-Q206M; N76D-S78F-S87R-G118R-S128L-P129Q-S130A-Q206M; N76D-S78G-S87R-G118R-S128L-P129Q-S130A-Q206M; N76D-S78I-S87R-G118R-S128L-P129Q-S130A-Q206M; N76D-S78K-S87R-G118R-S128L-P129Q-S130A-Q206M; N76D-S78L-S87R-G118R-S128L-P129Q-S130A-Q206M; N76D-S78M-S87R-G118R-S128L-P129Q-S130A-Q206M; N76D-S78Q-S87R-G118R-S128L-P129Q-S130A-Q206M; N76D-S78R-S87R-G118R-S128L-P129Q-S130A-Q206M; N76D-S78T-S87R-G118R-S128L-P129Q-S130A-Q206M; N76D-S78V-S87R-G118R-S128L-P129Q-S130A-Q206M; N76D-S78Y-S87R-G118R-S128L-P129Q-S130A-Q206M; N76D-S78A-S87R-G118R-S128L-P129Q-S130A-Q206N; N76D-S78C-S87R-G118R-S128L-P129Q-S130A-Q206N; N76D-S78E-S87R-G118R-S128L-P129Q-S130A-Q206N; N76D-S78G-S87R-G118R-S128L-P129Q-S130A-Q206N; N76D-S78H-S87R-G118R-S128L-P129Q-S130A-Q206N; N76D-S78I-S87R-G118R-S128L-P129Q-S130A-Q206N; N76D-S78L-S87R-G118R-S128L-P129Q-S130A-Q206N; N76D-S78M-S87R-G118R-S128L-P129Q-S130A-Q206N; N76D-S78Q-S87R-G118R-S128L-P129Q-S130A-Q206N; N76D-S78R-S87R-G118R-S128L-P129Q-S130A-Q206P; N76D-S78W-S87R-G118R-S128L-P129Q-S130A-Q206P; N76D-S78A-S87R-G118R-S128L-P129Q-S130A-Q206R; N76D-S78C-S87R-G118R-S128L-P129Q-S130A-Q206R; N76D-S78E-S87R-G118R-S128L-P129Q-S130A-Q206R; N76D-S78F-S87R-G118R-S128L-P129Q-S130A-Q206R; N76D-S78G-S87R-G118R-S128L-P129Q-S130A-Q206R; N76D-S78H-S87R-G118R-S128L-P129Q-S130A-Q206R; N76D-S78I-S87R-G118R-S128L-P129Q-S130A-Q206R; N76D-S78L-S87R-G118R-S128L-P129Q-S130A-Q206R; N76D-S78M-S87R-G118R-S128L-P129Q-S130A-Q206R; N76D-S78P-S87R-G118R-S128L-P129Q-S130A-Q206R; N76D-S78Q-S87R-G118R-S128L-P129Q-S130A-Q206R; N76D-S78R-S87R-G118R-S128L-P129Q-S130A-Q206R; N76D-S78T-S87R-G118R-S128L-P129Q-S130A-Q206R; N76D-S78V-S87R-G118R-S128L-P129Q-S130A-Q206R; N76D-S78C-S87R-G118R-S128L-P129Q-S130A-Q206S; N76D-S78E-S87R-G118R-S128L-P129Q-S130A-Q206S; N76D-S78H-S87R-G118R-S128L-P129Q-S130A-Q206S; N76D-S78M-S87R-G118R-S128L-P129Q-S130A-Q206S; N76D-S78W-S87R-G118R-S128L-P129Q-S130A-Q206S; N76D-S78C-S87R-G118R-S128L-P129Q-S130A-Q206Y; N76D-S78E-S87R-G118R-S128L-P129Q-S130A-Q206Y; N76D-S78H-S87R-G118R-S128L-P129Q-S130A-Q206Y; N76D-S78I-S87R-G118R-S128L-P129Q-S130A-Q206Y; N76D-S78K-S87R-G118R-S128L-P129Q-S130A-Q206Y; N76D-S78L-S87R-G118R-S128L-P129Q-S130A-Q206Y; N76D-S78M-S87R-G118R-S128L-P129Q-S130A-Q206; N76D-S78Q-S87R-G118R-S128L-P129Q-S130A-Q206Y; N76D-S78R-S87R-G118R-S128L-P129Q-S130A-Q206Y; N76D-S78T-S87R-G118R-S128L-P129Q-S130A-Q206Y; N76D-S78W-S87R-G118R-S128L-P129Q-S130A-Q206Y; N76D-S78Y-S87R-G118R-S128L-P129Q-S130A-Q206Y; N76D-S78H-S87R-G118R-S128L-P129Q-S130A-Q206A; N76D-S78H-S87R-G118R-S128L-P129Q-S130A-Q206D; N76D-S78I-S87R-G118R-S128L-P129Q-S130A-Q206D; N76D-S78L-S87R-G118R-S128L-P129Q-S130A-Q206D; N76D-S78P-S87R-G118R-S128L-P129Q-S130A-Q206D; N76D-S78C-S87R-G118R-S128L-P129Q-S130A-Q206A; N76D-S78Q-S87R-G118R-S128L-P129Q-S130A-Q206A; N76D-S78A-S87R-G118R-S128L-P129Q-S130A-Q206D; N76D-S78C-S87R-G118R-S128L-P129Q-S130A-Q206D; N76D-S78E-S87R-G118R-S128L-P129Q-S130A-Q206D; N76D-S78G-S87R-G118R-S128L-P129Q-S130A-Q206D; N76D-S78M-S87R-G118R-S128L-P129Q-S130A-Q206D; N76D-S78M-S87R-G118R-S128L-P129Q-S130A-Q206H; N76D-S78A-S87R-G118R-S128L-P129Q-S130A-Q206H; and N76D-S78H-S87R-G118R-S128L-P129Q-S130A-Q206M, wherein said variant has proteolytic activity and each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence.

Another embodiment is directed to an isolated subtilisin variant comprising a combination of amino acid substitutions selected from: N18R-S24R-N76D-S78N-H249R; N18R-S24R-N76D-S78N-S87R-H249R; N18R-S24R-N76D-S78N-Q206L-H249R; S24F-S78N-G118R-S166D; T22L-S24F-S78N-G118R-S166D-T213A; S24R-N76D-S87R-Q206Y-T213A-M222Q-H249R; S24R-N76D-S78N-S87D-G118R-Y209W-M222Q-H249R; S87D-Q206L-Y209W-T213A-H249R; S24R-N76D-S78N-S87R-G118R-Q206L-M222Q; S24R-N76D-S78N-Q206L-M222Q; N76D-S78N-S87R-G118R-S128L-P129Q-Q206L-M222Q; N76D-S78N-S87R-G118R-P129Q-Q206L-M222Q; N76D-S78N-S87R-G118R-S130A-Q206L-M222Q; N76D-S78N-S87R-G118R-S128L-P129Q-Q206L; N76D-S78N-S87R-G118R-S128L-S130A-Q206L; N76D-S78N-S87R-G118R-S128L-Q206L; N76D-S78N-S87R-G118R-P129Q-Q206L; N76D-S78N-S87R-G118R-S130A-Q206L; N76D-S78N-S87R-G118R-Q206L-M222Q; N76D-S78N-S87R-G118R-Q206L; S24R-N76D-S78N-S87R-G118R-Y209W-M222Q; S24R-N43R-N76D-S78N-S87R-G118R-Y209W-M222Q; G20R-S24R-N43R-N76D-S78N-S87R-G118R-Y209W-M222Q; G20R-N43R-N76D-S78N-S87R-G118R-Y209W-M222Q; S24R-N76D-S78N-S87R-G118R-Q206L-Y209W-T213A-M222Q; S24R-N76D-S78N-S87R-G118R-Q206L-T213A-M222Q; S24R-N76D-S78N-S87R-G118R-Y209W-T213A-M222Q; S24R-N76D-S78N-S87R-N116L-G118R-Y209W-M222Q; G20R-S24R-N43R-N76D-S78N-S87R-N116L-G118R-Y209W-M222Q; N18R-N76D-S87R-S128L-P129Q-S130A-Q206L-Y209W-H249R; N18R-S87D-S166N-Q206L-Y209W; N18R-S24R-N76D-S78N-S87R-G118R-G127T-Y209W-T213A; N18R-S24R-S166D-Q206Y-H249R; S24R-S78N-S87R-S166D-Q206L-Y209W-H249R; N76D-S78N-S87R-S101G-S103A-V104I-G118R-Q206L; N76D-S78N-S87R-G118R-G127T-Q206L; N76D-S78N-S87R-G118R-G127T-P129Q-Q206L; N76D-S78N-S87R-G118R-G127T-P129Q-S130A-Q206L; N76D-S78N-S87R-S101G-S103A-V104I-G118R-G127T-P129R-Q206L; S3V-S24R-N76D-S78N-S87D-G118R-Y209W-M222Q-H249R; S24R-N76D-S78N-S87D-S101V-G118R-Y209W-M222Q-H249R; S24R-N76D-S78N-S87D-S101G-S103A-V104I-G118R-Y209W-M222Q-H249R; S24R-N76D-S78N-S87D-G118R-Y209W-S212D-M222Q-H249R; S3V-S24R-N76D-S78N-S87D-S101G-S103A-V104I-G118R-Y209W-M222Q-H249R; S24R-N76D-S78N-S87D-S101G-S103A-V104I-G118R-G127T-Y209W-T213A-M222Q-H249R; S24R-N76D-S78N-S87D-S101G-S103A-V104I-G118R-Y209W-M222Q-A232V-Q245R-H249R; S24R-N76D-S78N-S87D-S101G-S103A-

V104I-G118R-Y209W-H249R; S3V-S24R-N76D-S78N-S87D-S101G-S103A-V104I-G118R-Y209W-H249R; S24R-N76D-S78N-S87D-S101G-S103A-V104I-G118R-G127T-Y209W-T213A-H249R; S24R-N76D-S78N-S87D-S101T-G118R-Y209W-M222Q-H249R; S24R-N76D-S78N-S87D-S101H-G118R-Y209W-M222Q-H249R; S24R-N76D-S78N-S87D-G118R-P129Q-Y209W-M222Q-H249R; N76D-S78N-S87D-G118R-S128L-P129Q-S130A-Q206L; S24R-N76D-S78N-S87D-G118R-Y209W-H249R; S24R-N76D-S78N-S87R-G118R-Y209W-M222Q-H249R; N76D-S87R-S128L-P129Q-S130A-Q206L-Y209W-H249R; N76D-S87R-S128L-P129Q-S130A-Q206L-Y209W; S24R-N76D-S78N-S87D-G118R-Y209W-M222S-H249R; N76D-S78N-S87D-G118R-Y209W-H249R; N76D-S78N-S87D-G118R-Y209W-M222S-H249R; S24R-N76D-S78N-S87D-G118R-M222Q-H249R; S24R-N76D-S78N-S87D-G118R-S128L-P129Q-S130A-Q206L-T213A; S24R-V28T-N76D-S78N-S87D-S101V-A108S-G118R-S128L-P129Q-S130A-Q206L; S24R-V28T-N76D-S78N-S87D-S101V-N116M-G118R-S128L-P129Q-S130A-A158E-Q206L; S3V-S24R-N76D-S78N-S87R-G100S-S101V-G118R-Q206L-L217K; N76D-N77D-S78N-S87R-G118R-Q206L-T213A; S24R-N76D-S78N-S87D-G100S-S101V-N116M-G118R-L124M-S128L-P129Q-S130A-A194D-Q206L; S24R-V28T-N76D-S78N-S87R-G118V-S128L-P129Q-S130A-Q206L-T213A-L217K; S3V-S24R-N76D-S78N-S87D-G118R-Y209W-H249R; S3V-N76D-S78N-S87D-G118R-Y209W-H249R; S3I-N43Y-L82D-G127S-S216Y-L217K-S256P; G127S-S216Y; S3V-18V-P40E-N76D-S87D-G118R-S128R-A215K-N261I; S3V-18V-P40E-N76D-G118R-S128R-P210I-N261I; S3V-P40E-N76D-S87D-G118R-S128R-P210I-L217K; S3V-N76D-G118R-S128R; S3V-N76D-S87D-G118R-S128R; S3V-N76D-G118R-S128R-P210I; S3V-N76D-G118R-S128R-N261I; S3V-P40E-N76D-G118R; S3V-P40E-N76D-G118R-S128R; S3V-18V-P40E-N76D-G118R-S128R; S3V-P40E-N76D-S87D-G118R-S128R; S3V-P40E-N76D-G118R-S128R-S160Q; S3V-P40E-N76D-G118R-S128R-P210I; S3V-P40E-N76D-G118R-S128R-G211P; S3V-P40E-N76D-G118R-S128R-A215K; S3V-P40E-N76D-G118R-S128R-L217K; S3V-P40E-N76D-G118R-S128R-N261I; S3V-P40E-N76D-G118R-S128R-L262Q; S3V-18V-P40E-N76D-G118R; S3V-P40E-N76D-S87D-G118R; S3V-P40E-N76D-G118R-S160Q; S3V-P40E-N76D-G118R-Q206Y; S3V-P40E-N76D-G118R-P210I; S3V-P40E-N76D-G118R-G211P; S3V-P40E-N76D-G118R-A215K; S3V-P40E-N76D-G118R-L217K; S3V-P40E-N76D-G118R-N261I; S3V-P40E-N76D-G118R-L262Q; S3V-N76D-G118R-S128R-G211P; S3V-N76D-G118R-S128R-L262Q; T22W-N76D-S78N-S87R-G118R-S128R-P129Q-S130A-V147I-A194P-A215V-E271D; N76D-S78N-S87R-G118R-S128R-P129Q-S130A; N76D-S78N-S87R-G118R-S128R-P129Q-S130A-V147I-A194P-A215V; N76D-S78N-S87R-G118R-S128R-P129Q-S130A-V147I-A194P-E271D; T22W-N76D-S78N-S87R-G118R-S128R-P129Q-S130A-A215V-E271D; T22W-N76D-S78N-S87R-G118R-S128R-P129Q-S130A-A194P-E271D; P40E-N76D-S78G-G118R-S128R-Q206Y-L262Q; S3V-P40E-N76D-G118R-G211P-L217K-N261I; 18V-P40E-N76D-S78G-G118R-Q206Y-L217K; S3V-I8V-N76D-S78G-S87D-G118R-P210I-A215K-N252I; S3V-P40E-N76D-G118R-S160Q-P210I-L217K-N261I; I8V-N76D-S78G-G118R-S160Q-Q206Y-N252I-N261I; 18V-P40E-N76D-G118R-P210I-A215K-N261I; I8V-P40E-N76D-S78G-G118R-Q206Y-P210I-A215K-N261I; S3V-N76D-G118R-S160Q-G211P-A215V-L262Q; S3V-N76D-S87D-G118R-S128R-P210I-G211P-N261I-L262Q; S3V-

P40E-N76D-G118R-Q206Y-P210I-G211P-A215K-N261I; 18V-P40E-N76D-S78G-G118R-G211P-L217K-N252I-N261I; S3V-P40E-N76D-S87D-G118R-S128R-P210I-L217K-N261I; S3V-P40E-N76D-G118R-S160Q-P210I-W241K-L262Q; I8V-N76D-S78G-G118R-P210I-A215V-N261I; N76D-S78G-S87D-G118R-P210I-A215V-L217K-N261I-L262Q; S3V-P40E-N76D-S78G-G118R-Q206Y-L217K; S3V-P40E-N76D-S78G-G118R-S128L-P129Q-S130A-L217K; S3V-P40E-N76D-S78G-G118R-S128L-P129Q-S130A-Q206Y-P210I-A215V-L217K; N76D-S78N-S87D-G118R-S128L-P129Q-S130A-Q206Y; S3V-P40E-N76D-S78G-G118R-S128L-P129Q-S130A-A215K-N261I; S3V-N76D-S87D-G118R-S128L-P129Q-S130A-P210I-L217K; N76D-S87R-G118R-S128K-V150T-L217K; N76D-S78N-S87R-G118R-S128K-V150T-L217K; N76D-S78N-S87R-G118R-S128K-V150T; S3V-N76D-S78G-S87D-G118A-S166N-A194P-Q206M-P210I-N218S-N248D-N261I-L262Q; S3V-N76D-S78G-S87T-S101Q-G118A-S130Q-S166N-A194P-P210I-N218S-N248D-S256P-N261I; S3V-N76D-S78G-S87D-S101Q-G118A-Q206M-P210I-L217K-N218S-M222Q-N248D-S256P; S24L-N76D-S78N-S87D-A88S-G118R-Q206Y-Y209W-H249R; N18R-S87R-G118R-S166N-N204D-Q206L-Y209W; N18R-S24R-L42I-G118R-Y209W-T213A-M222Q-H249R; N18R-S24R-Y209W-T213A-H249R; N18R-S24R-S87R-G118R-S128L-P129Q-S130A-Q206Y-Y209W-T213A-H249R; S24R-S87D-G118R-Y209W-T213A-H249R; S9G-N18R-S24R-N76D-G118R-S166N-Q206L-H249R; N18R-G118R-Q206L-Y209W-T213A-M222Q-H249R; S24R-S87R-S166N; N18R-S24R-S87R-Q206L-Y209W-T213A; N18R-S24R-G118R-A158V-Y209W; N18R-S24R-S87D-Q206L-Y209W-M222Q-H249R; N18R-S24R-S87R-G127T; S24R-S166N-Y209W-T213A; N76D-S78N-G118R-Y209W-H249R; N18R-N76D-S78N-S87R-Q206L-Y209W-H249R-S259G; N18R-S24R-S87D-N185Y-Q206L-Y209W-T213A-M222Q-H249R; S24R-G118R-G127T-Y209W; A1V-N18R-S24R-S56P-G127T-Q206L-Y209W; S87R-Y209W; N18R-S87D-Y209W-M222Q-H249R; N18R-S24R-G118R-S128L-P129Q-S130A-S166D-Y209W-T213A; S87D-S166D-T213A-H249R; N18R-S24P-S87D-S166N-Q206L-Y209W-M222Q-H249R; N76D-S166N-Y209W-T213A-H249R; S24R-Q206L-Y209W-T213A-M222Q-H249R; N18R-G118R-Q206L-Y209W N18R-S24R-S166D-Q206Y-H249R-A254T; N18R-S24R-S78N-Q206L-Y209W-T213A-M222Q-H249R; N18R-S24R-G118R-G127T-Y209W; S24R-N76D-G118R-S166N-Q206L-Y209W; S24R-N76D-S87R-Y209W-T213A-M222Q-H249R; N18K-S87R-Y209W-T213A-M222Q-H249R; N18R-S24R-S87R-Y209W; N18R-S78N-G118R-Y209W-T213A-M222Q-H249R-A270P; N18R-S166N-Y209W-T213A-M222Q; S24R-N76D-S78N-S128L-P129Q-S130A-Q206L-H249R; N18R-S24R-N76D-S78N-S128L-P129Q-S130A-Q206L-H249R; N76D-S78N-G118R-Q206L-H249R; N18R-I44V-N76D-S78N-S87R-S128L-P129Q-S130A-Q206L-H249R; N18R-N76D-S78N-S87R-Q206L-H249R; N18R-S24R-N76D-S78N-S87R-S128L-P129Q-S130A-Q206L; N76D-S78N-G118R-Q206L; A16T-N18R-S24R-N76D-S78N-G118R-S128L-P129Q-S130A-Q206L; S24R-N76D-S78N-Q206L-H249R; S24R-N76D-S78N-S87R-S128L-P129Q-S130A-Q206L; N18R-N76D-S78N-S87R-S128L-P129Q-S130A-Q206L; N18R-S24R-N76D-S78N-S128L-P129Q-S130A; S24R-N76D-S78N-H249R; N18R-S24R-N76D-S78N-G118R-S128L-P129Q-S130A-H249R; N18R-S24R-N76D-S78N-M222Q-H249R; N76D-S78N-S87R-Q206L-H249R; N18R-N76D-S78N-Q206L-H249R; N18R-S24R-N76D-S78N-G118R-Q206L-K251R; N76D-

S78N-Q206L-H249R; N18R-S24R-N76D-S78N-S87R-Q206L; N18R-S24R-N76D-S78N-G118R-S128L-P129Q-S130A; N76D-S78N-H120R-Q206L-H249R; N18R-N76D-S78N-S87R-S128L-P129Q-S130A-Q206L-H249R; N18R-G20E-N76D-S78N-G118R-H249R; S24R-N76D-S78N-G118R-S128L-P129Q-S130A; N76D-S78N-G118R-S128L-P129Q-S130A-Q206L-H249R; S24R-N76D-S78N-G118R-Q206L; N18R-N76D-S78N-S128L-P129Q-S130A-Q206L-V268A; and N18R-N76D-S78N-S87R-Q206L-N218S-M222Q-H249R, wherein said variant has proteolytic activity and each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence. A further embodiment is directed to an isolated subtilisin variant comprising a combination of amino acid substitutions selected from: N18R-S24R-N76D-S78N-H249R; N18R-S24R-N76D-S78N-S87R-H249R; N18R-S24R-N76D-S78N-Q206L-H249R; S24F-S78N-G118R-S166D; T22L-S24F-S78N-G118R-S166D-T213A; S24R-N76D-S87R-Q206Y-T213A-M222Q-H249R; S24R-N76D-S78N-S87R-G118R-Y209W-M222Q-H249R; S87D-Q206L-Y209W-T213A-H249R; S24R-N76D-S78N-S87R-G118R-Q206L-M222Q; S24R-N76D-S78N-Q206L-M222Q; N76D-S78N-S87R-G118R-S128L-P129Q-Q206L-M222Q; N76D-S78N-S87R-G118R-P129Q-Q206L-M222Q; N76D-S78N-S87R-G118R-S130A-Q206L-M222Q; N76D-S78N-S87R-G118R-S128L-P129Q-Q206L; N76D-S78N-S87R-G118R-S128L-S130A-Q206L; N76D-S78N-S87R-G118R-S128L-Q206L; N76D-S78N-S87R-G118R-P129Q-Q206L; N76D-S78N-S87R-G118R-S130A-Q206L; N76D-S78N-S87R-G118R-Q206L-M222Q; N76D-S78N-S87R-G118R-Q206L; S24R-N76D-S78N-S87R-G118R-Y209W-M222Q; S24R-N43R-N76D-S78N-S87R-G118R-Y209W-M222Q; G20R-S24R-N43R-N76D-S78N-S87R-G118R-Y209W-M222Q; G20R-N43R-N76D-S78N-S87R-G118R-Y209W-M222Q; S24R-N76D-S78N-S87R-G118R-Q206L-Y209W-T213A-M222Q; S24R-N76D-S78N-S87R-G118R-Q206L-T213A-M222Q; S24R-N76D-S78N-S87R-G118R-Y209W-T213A-M222Q; S24R-N76D-S78N-S87R-N116L-G118R-Y209W-M222Q; G20R-S24R-N43R-N76D-S78N-S87R-N116L-G118R-Y209W-M222Q; N18R-N76D-S87R-S128L-P129Q-S130A-Q206L-Y209W-H249R; N18R-S87D-S166N-Q206L-Y209W; N18R-S24R-N76D-S78N-S87R-G118R-G127T-Y209W-T213A; N18R-S24R-S166D-Q206Y-H249R; S24R-S78N-S87R-S166D-Q206L-Y209W-H249R; N76D-S78N-S87R-S101G-S103A-V104I-G118R-Q206L; N76D-S78N-S87R-G118R-G127T-Q206L; N76D-S78N-S87R-G118R-G127T-P129Q-Q206L; N76D-S78N-S87R-G118R-G127T-P129Q-S130A-Q206L; N76D-S78N-S87R-S101G-S103A-V104I-G118R-G127T-P129Q-Q206L; S3V-S24R-N76D-S78N-S87R-G118R-Y209W-M222Q-H249R; S24R-N76D-S78N-S87R-S101V-G118R-Y209W-M222Q-H249R; S24R-N76D-S78N-S87D-S101G-S103A-V104I-G118R-Y209W-M222Q-H249R; S24R-N76D-S78N-S87D-G118R-Y209W-S212D-M222Q-H249R; S3V-S24R-N76D-S78N-S87D-S101G-S103A-V104I-G118R-Y209W-M222Q-H249R; S24R-N76D-S78N-S87D-S101G-S103A-V104I-G118R-G127T-Y209W-T213A-M222Q-H249R; S24R-N76D-S78N-S87D-S101G-S103A-V104I-G118R-Y209W-M222Q-A232V-Q245R-H249R; S24R-N76D-S78N-S87D-S101G-S103A-V104I-G118R-Y209W-H249R; S3V-S24R-N76D-S78N-S87D-S101G-S103A-V104I-G118R-Y209W-H249R; S24R-N76D-S78N-S87D-S101G-S103A-V104I-G118R-G127T-Y209W-T213A-H249R; S24R-N76D-S78N-S87D-S101T-G118R-Y209W-M222Q-H249R; S24R-N76D-S78N-S87D-S101H-G118R-Y209W-M222Q-H249R; S24R-N76D-S78N-S87D-G118R-P129Q-Y209W-M222Q-H249R; N76D-S78N-S87D-G118R-S128L-P129Q-S130A-Q206L; S24R-N76D-S78N-S87D-G118R-Y209W-H249R; S24R-N76D-S78N-S87R-G118R-Y209W-M222Q-H249R; N76D-S87D-S128L-P129Q-S130A-Q206L-Y209W-H249R; N76D-S87R-S128L-P129Q-S130A-Q206L-Y209W; S24R-N76D-S78N-S87D-G118R-Y209W-M222S-H249R; N76D-S78N-S87D-G118R-Y209W-H249R; N76D-S78N-S87D-G118R-Y209W-M222S-H249R; S24R-N76D-S78N-S87D-G118R-M222Q-H249R; S24R-N76D-S78N-S87D-G118R-S128L-P129Q-S130A-Q206L-T213A; S24R-V28T-N76D-S78N-S87D-S101V-A108S-G118R-S128L-P129Q-S130A-Q206L; S24R-V28T-N76D-S78N-S87D-S101V-N116M-G118R-S128L-P129Q-S130A-A158E-Q206L; S3V-S24R-N76D-S78N-S87R-G100S-S101V-G118R-Q206L-L217K; N76D-N77D-S78N-S87R-G118R-Q206L-T213A; S24R-N76D-S78N-S87D-G100S-S101V-N116M-G118R-L124M-S128L-P129Q-S130A-A194D-Q206L; S24R-V28T-N76D-S78N-S87R-G118V-S128L-P129Q-S130A-Q206L-T213A-L217K; N18R-S87R-G118R-S166N-N204D-Q206L-Y209W; N18R-S24R-L42I-G118R-Y209W-T213A-M222Q-H249R; N18R-S24R-Y209W-T213A-H249R; N18R-S24R-S87R-G118R-S128L-P129Q-S130A-Q206Y-Y209W-T213A-H249R; S24R-S87D-G118R-Y209W-T213A-H249R; S9G-N18R-S24R-N76D-G118R-S166N-Q206L-H249R; N18R-G118R-Q206L-Y209W-T213A-M222Q-H249R; S24R-S87R-S166N; N18R-S24R-S87R-Q206L-Y209W-T213A; N18R-S24R-G118R-A158V-Y209W; N18R-S24R-S87D-Q206L-Y209W-M222Q-H249R; N18R-S24R-S87R-G127T; S24R-S166N-Y209W-T213A; N76D-S78N-G118R-Y209W-H249R; N18R-N76D-S78N-S87R-Q206L-Y209W-H249R-S259G; N18R-S24R-S87D-N185Y-Q206L-Y209W-T213A-M222Q-H249R; S24R-G118R-G127T-Y209W; A1V-N18R-S24R-S56P-G127T-Q206L-Y209W; S87R-Y209W; N18R-S87D-Y209W-M222Q-H249R; N18R-S24R-G118R-S128L-P129Q-S130A-S166D-Y209W-T213A; S87D-S166D-T213A-H249R; N18R-S24P-S87D-S166N-Q206L-Y209W-M222Q-H249R; N76D-S166N-Y209W-T213A-H249R; S24R-Q206L-Y209W-T213A-M222Q-H249R; N18R-G118R-Q206L-Y209W; N18R-S24R-S166D-Q206Y-H249R-A254T; N18R-S24R-S78N-Q206L-Y209W-T213A-M222Q-H249R; N18R-S24R-G118R-G127T-Y209W; S24R-N76D-G118R-S166N-Q206L-Y209W; S24R-N76D-S87R-Y209W-T213A-M222Q-H249R; N18K-S87R-Y209W-T213A-M222Q-H249R; N18R-S24R-S87R-Y209W; N18R-S78N-G118R-Y209W-T213A-M222Q-H249R-A270P; N18R-S166N-Y209W-T213A-M222Q; S24R-N76D-S78N-S128L-P129Q-S130A-Q206L-H249R; N18R-N76D-S78N-S128L-P129Q-S130A-Q206L-H249R; N76D-S78N-G118R-Q206L-H249R; N18R-I44V-N76D-S78N-S87R-S128L-P129Q-S130A-Q206L-H249R; N18R-N76D-S78N-S87R-Q206L-H249R; N18R-S24R-N76D-S78N-S87R-S128L-P129Q-S130A-Q206L; N76D-S78N-G118R-Q206L; A16T-N18R-S24R-N76D-S78N-G118R-S128L-P129Q-S130A-Q206L; S24R-N76D-S78N-Q206L-H249R; S24R-N76D-S78N-S87R-S128L-P129Q-S130A-Q206L; N18R-N76D-S78N-S87R-S128L-P129Q-S130A-Q206L; N18R-S24R-N76D-S78N-S87R-S128L-P129Q-S130A; S24R-N76D-S78N-H249R; N18R-S24R-N76D-S78N-G118R-S128L-P129Q-S130A-H249R; N18R-S24R-N76D-S78N-M222Q-H249R; N76D-S78N-S87R-Q206L-H249R; N18R-N76D-S78N-Q206L-H249R; N18R-S24R-N76D-S78N-G118R-Q206L-K251R;

N76D-S78N-Q206L-H249R; N18R-S24R-N76D-S78N-S87R-Q206L; N18R-S24R-N76D-S78N-G118R-S128L-P129Q-S130A; N76D-S78N-H120R-Q206L-H249R; N18R-N76D-S78N-S87R-S128L-P129Q-S130A-Q206L-H249R; N18R-G20E-N76D-S78N-G118R-H249R; S24R-N76D-S78N-G118R-S128L-P129Q-S130A; N76D-S78N-G118R-S128L-P129Q-S130A-Q206L-H249R; S24R-N76D-S78N-G118R-Q206L; N18R-N76D-S78N-S128L-P129Q-S130A-Q206L-V268A; and N18R-N76D-S78N-S87R-Q206L-N218S-M222Q-H249R, wherein said variant has proteolytic activity and each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence.

In another embodiment, one or more subtilisin variant described herein further comprises one or more substitution, insertion, and/or deletion selected from V4I, S9R, A15T, K27R, *36D, V68A, *97E, A98S, S99A/D/E/G/V, G100A, S101D/E/M/R, V104Y/N, S106A, H120D/N, N123S, G160D, Y167A, R170S, G195E, V199M, V205I, L217D, N218D, K235L, Q236H, N252K, T274A. and D inserted between position 99 and 100, wherein said variant has proteolytic activity and each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence A further embodiment is directed to one or more isolated, recombinant, substantially pure, and/or non-naturally occurring subtilisin variant. In a still further embodiment, one or more subtilisin variant described herein has enzymatic activity. In yet another embodiment, one or more subtilisin variant described herein has proteolytic activity. In one embodiment, one or more subtilisin variant described herein has at least 70, 75, 80, 85, 90, 91, 92, 93, 94, 95, 96, 97, 98, 99% or less than amino acid sequence identity to SEQ ID NO: 1, SEQ ID NO:2, or SEQ ID NO:14. In an even yet further embodiment, one or more subtilisin variant described herein has at least 70, 75, 80, 85, 90, 91, 92, 93, 94, 95, 96, 97, 98, or 99% amino acid sequence identity to SEQ ID NO:1 or SEQ ID NO:2. In a still further embodiment, one or more subtilisin variant described herein has at least 70, 75, 80, 85, 90, 91, 92, 93, 94, 95, 96, 97, 98, 99% or less than 100% amino acid sequence identity to SEQ ID NO: 1. In yet a still further embodiment, one or more subtilisin variant described herein has at least 70, 75, 80, 85, 90, 91, 92, 93, 94, 95, 96, 97, 98, 99% or less than 100% amino acid sequence identity to SEQ ID NO:2. In an even yet still further embodiment, one or more subtilisin variant described herein has at least 70, 75, 80, 85, 90, 91, 92, 93, 94, 95, 96, 97, 98, or 99% amino acid sequence identity to SEQ ID NO:2. In a further embodiment, one or more subtilisin variant described herein has at least 70, 75, 80, 85, 90, 91, 92, 93, 94, 95, 96, 97, 98, 99% or less than 100% amino acid sequence identity to SEQ ID NO: 14. In one embodiment, one or more subtilisin variant described herein has at least 80, 85, 90, 91, 92, 93, 94, 95, 96, 97, 98, 99% or less than 100% amino acid sequence identity to SEQ ID NO: 1, SEQ ID NO:2, or SEQ ID NO: 14. In another embodiment, one or more subtilisin variant described herein has at least 80, 85, 90, 91, 92, 93, 94, 95, 96, 97, 98, 99% or less than 100% amino acid sequence identity to SEQ ID NO:1 or SEQ ID NO:2. In still another embodiment, one or more subtilisin variant described herein has at least 80, 85, 90, 91, 92, 93, 94, 95, 96, 97, 98, 99% or less than 100% amino acid sequence identity to SEQ ID NO: 1. In yet another embodiment, one or more subtilisin variant described herein has at least 80, 85, 90, 91, 92, 93, 94, 95, 96, 97, 98, 99% or less than 100% amino acid sequence identity to SEQ ID NO:2. In yet still another embodiment, one or more subtilisin variant described herein has at least 80, 85, 90, 91, 92, 93, 94, 95, 96, 97, 98, 99% or less than 100% amino acid sequence identity to SEQ ID NO: 14. In even still yet another embodiment, one or more subtilisin variant described herein has at least 90, 91, 92, 93, 94, 95, 96, 97, 98, 99% or less than 100% amino acid sequence identity to SEQ ID NO: 1, SEQ ID NO:2 or SEQ ID NO: 14. In still yet another embodiment, one or more subtilisin variant described herein has at least 90, 91, 92, 93, 94, 95, 96, 97, 98, 99%, or less than 100% amino acid sequence identity to SEQ ID NO:1 or SEQ ID NO:2. In an even further embodiment, one or more subtilisin variant described herein has at least 90, 91, 92, 93, 94, 95, 96, 97, 98, 99%, or less than 100% amino acid sequence identity to SEQ ID NO: 1. In yet still an even further embodiment, one or more subtilisin variant described herein has at least 90, 91, 92, 93, 94, 95, 96, 97, 98, 99%, or less than 100% amino acid sequence identity to SEQ ID NO:2. In an even further embodiment, one or more subtilisin variant described herein has at least 90, 91, 92, 93, 94, 95, 96, 97, 98, 99%, or less than 100% amino acid sequence identity to SEQ ID NO: 14.

In another embodiment, one or more subtilisin variant described herein has one or more improved property when compared to a parent or benchmark protease, wherein the improved property is selected from improved protease activity, improved cleaning performance in detergent, and improved thermostability in detergent. In one embodiment, one or more subtilisin variant described herein has one or more improved property when compared to SEQ ID NO:1, SEQ ID NO:2, and/or SEQ ID NO:14, wherein the improved property is selected from improved protease activity, improved cleaning performance in detergent, and improved thermostability in detergent. In a further embodiment, one or more subtilisin variant described herein has one or more improved property when compared to SEQ ID NO:1 and/or SEQ ID NO:2, wherein the improved property is selected from improved protease activity, improved cleaning performance in detergent, and improved thermostability in detergent. In still a further embodiment, one or more subtilisin variant described herein has one or more improved property when compared to SEQ ID NO: 1, wherein the improved property is selected from improved protease activity, improved cleaning performance in detergent, and improved thermostability in detergent. In yet a further embodiment, one or more subtilisin variant described herein has one or more improved property when compared to SEQ ID NO:2, wherein the improved property is selected from improved protease activity, improved cleaning performance in detergent, and improved thermostability in detergent. In yet an even still further embodiment, one or more subtilisin variant described herein has one or more improved property when compared to SEQ ID NO:14, wherein the improved property is selected from improved protease activity, improved cleaning performance in detergent, and improved thermostability in detergent.

In one embodiment, the subtilisin variant described herein is more stable through a longer wash period as compared to a parent or benchmark protease. In another embodiment, the subtilisin variant described herein is more stable through a short and cool or long and hot wash-cycle as compared to a parent or benchmark protease. In one embodiment, the one or more improved property is (i) improved protease activity and said variant has a PI>1 on skim milk substrate; (ii) improved cleaning performance and said variant has an egg yolk swatch cleaning PI>1; (iii) improved thermostability and said variant has a stability PI>1; and (iv) improved thermostability and said variant has a residual activity ≥10%, optionally, when measured at 50° C., 59° C., and/or 61° C. In a still yet further embodiment, the one or more improved property is (i) improved protease activity and said variant has a PI>1 on skim milk substrate; (ii) improved cleaning performance and said variant has an egg yolk swatch cleaning PI>1; and/or (iii) improved thermostability and said variant has a stability PI>1. In an even further embodiment, one or more subtilisin variant described herein has improved protease activity, wherein said variant has a PI>1 on skim milk substrate. In a still even further embodiment, one or more subtilisin variant described herein has improved cleaning performance, wherein said variant has an egg yolk swatch cleaning PI>1. In another embodiment, one or more subtilisin variant described herein has improved thermostability, wherein said variant has a stability PI>1. In a further embodiment, one or more subtilisin variant described herein has improved thermostability, wherein said variant has a residual activity ≥10%, optionally, when measured at 50° C., 59° C., and/or 61° C. In another embodiment, one or more subtilisin variant described herein has improved protease activity, wherein said variant has a PI>1 on skim milk substrate and said PI is measured in accordance with the protease activity assay of Example 1. In a further embodiment, one or more subtilisin variant described herein has improved cleaning performance, wherein said variant has an egg yolk swatch cleaning PI>1 and said PI is measured in accordance with the cleaning performance in detergent assay of Example 1. In an even further embodiment, one or more subtilisin variant described herein has improved thermostability, wherein said variant has a stability PI>1 and said PI is measured in accordance with the thermostability in detergent assay of Example 1. In yet an even still further embodiment, one or more subtilisin variant described herein has improved thermostability, wherein said variant has a residual activity ≥10% when measured at 50° C., 59° C., and/or 61° C. in the thermostability in laundry detergent assay described in Example 1.

One embodiment is directed to one or more isolated, non-naturally occurring, and/or recombinant nucleic acid sequences comprising a polynucleotide sequence that encodes one or more subtilisin variant described herein. The one or more nucleic acid sequence described herein can be generated by using any suitable synthesis, manipulation, and/or isolation techniques, or combinations thereof.

For example, the one or more polynucleotide sequence described herein may be produced using standard nucleic acid synthesis techniques, such as, for example, solid-phase synthesis techniques. In such techniques, fragments of up to 50 or more nucleotide bases are typically synthesized, then joined (e.g., by enzymatic or chemical ligation methods, or polymerase mediated recombination methods) to form essentially any desired continuous nucleic acid sequence. Synthesis of the nucleic acids described herein can be also facilitated (or alternatively accomplished) by chemical synthesis using, e.g., the classical phosphoramidite method, which is described in, e.g., Beaucage et al., Tetrahedron Letters 22:1859-69 (1981), or the method described by Matthes et al., EMBO J. 3:801-05 (1984), e.g., as is typically practiced in automated synthetic methods. Nucleic acids described herein can also be produced by using an automatic DNA synthesizer. Customized nucleic acids can be ordered from a variety of commercial sources, such as Midland Certified Reagent Co. (mcrc@oligos.com), Great American Gene Co. (genco.com), Operon Technologies Inc. (Alameda, Calif.), and DNA2.0 (Menlo Park, CA). Other techniques for synthesizing nucleic acids and related principles are described in, e.g., Itakura et al., Annu. Rev. Biochem., 53:323 (1984) and Itakura et al., Science 198: 1056 (1984).

Recombinant DNA techniques can be used to modify one or more nucleic acid sequence described herein including, for example, restriction endonuclease digestion, ligation, reverse transcription and cDNA production, and polymerase chain reaction (e.g., PCR). Useful recombinant DNA technology techniques and principles related thereto are described in Sambrook et al. (1989), "Molecular Cloning: A Laboratory Manual", Cold Spring Harbor Press, and third edition thereof (2001); Ausubel et al. (1994-1999), "Current Protocols in Molecular Biology", Wiley Interscience Publishers; and Berger and Kimmel, "Guide to Molecular Cloning Techniques," Methods in Enzymol., Vol. 152, Acad. Press, Inc.

Nucleotides described herein may also be obtained by screening cDNA libraries (generated using mutagenesis techniques commonly used in the art, including those described herein) using one or more oligonucleotide probes that can hybridize to or PCR-amplify polynucleotides that encode one or more subtilisin variant described herein. Procedures for screening and isolating cDNA clones and PCR amplification procedures are well known to those of skill in the art and described in, e.g., Berger, Sambrook, and Ausubel, supra. Nucleic acid sequences described herein may also be obtained by altering a naturally occurring polynucleotide backbone (e.g., that encodes a parent protease) by, e.g., a known mutagenesis procedure.

The one or more isolated, non-naturally occurring, and/or recombinant nucleic acid sequences described herein are useful in recombinant production (e.g., expression) of one or more subtilisin variant described herein, typically through expression of a plasmid expression vector. Accordingly, a further embodiment is directed to one or more: isolated or recombinant vector comprising one or more polynucleotide described herein; isolated or recombinant expression vector or expression cassette comprising one or more polynucleotide described herein; isolated, substantially pure, or recombinant DNA construct comprising one or more polynucleotide described herein; isolated or recombinant cell comprising one or more polynucleotide described herein; cell culture comprising cells comprising one or more polynucleotide described herein; cell culture comprising one or more polynucleotide described herein; and/or composition comprising one or more vector, polynucleotide sequence, expression vector, expression cassette, DNA construct, cell, cell culture, or any combination or mixture thereof.

Another embodiment is directed to an expression vector comprising one or more isolated, non-naturally occurring, and/or recombinant nucleic acid sequence comprising a polynucleotide sequence that encodes one or more subtilisin variant described herein. A further embodiment is directed to an expression vector comprising one or more nucleic acid sequence comprising a polynucleotide sequence that encodes one or more subtilisin variant described herein. In a still further embodiment, the one or more polynucleotide sequence described herein is operably linked to one or more nucleic acid segment required for efficient gene expression (e.g., a promoter operably linked to the polynucleotide encoding the one or more subtilisin variant described herein). A vector may include a transcription terminator and/or a selection gene, such as an antibiotic resistance gene that enables continuous cultural maintenance of plasmid-infected host cells by growth in antimicrobial-containing media.

An expression vector may be derived from plasmid or viral DNA, or in alternative embodiments, contains elements of both. Harwood and Cutting (eds.), "Molecular Biological Methods for *Bacillus*", John Wiley & Sons (1990) describe exemplary vectors including, but not limited to, e.g., pXX, pC194, pJH101, pE194, and pHP13, as well as suitable replicating plasmids for *B. subtilis*. Exemplary vectors are further described in, e.g., Perego, M., "Integrational Vectors for Genetic Manipulations in *Bacillus subtilis*" (1993) and A. L. Sonenshein, J. A. Hoch, and R. Losick (ed.), "*Bacillus subtilis* and other Gram-positive bacteria: biochemistry, physiology and molecular genetics", American Society for Microbiology.

A still further embodiment is directed to one or more recombinant cell comprising one or more vector (e.g., expression vector or DNA construct) comprising one or more polynucleotide described herein. Some such recombinant cells are transformed or transfected with the one or more vector. Such cells are typically referred to as host cells. Some such cells comprise bacterial cells, including, but not limited to, e.g., *Bacillus* sp. cells, such as, e.g., *B. subtilis* cells. A further embodiment is directed to recombinant cells comprising one or more subtilisin variant described herein.

For a cell to express and produce the one or more subtilisin variant described herein, one or more expression vector comprising one or more copy of the polynucleotide encoding the one or more subtilisin variant is transformed into the cell under conditions suitable for expression of the subtilisin. In one embodiment, the one or more polynucleotide sequence described herein (as well as other sequences included in the vector) is integrated into the genome of the host cell. In another embodiment, the one or more plasmid vector comprising the one or more polynucleotide sequence described herein remains an autonomous extra-chromosomal element within the cell. In a further embodiment, the polynucleotide construct encoding the one or more subtilisin variant is present on an integrating vector that enables the integration and optionally the amplification of the polynucleotide encoding the subtilisin variant into the bacterial chromosome.

In some embodiments, transcription of a polynucleotide described herein is effectuated by a promoter that is the wild-type promoter for the selected precursor protease. In some other embodiments, the promoter is heterologous to the precursor protease, but is functional in the host cell. Examples of suitable promoters for use in bacterial host cells include, but are not limited to, e.g., amyE, amyQ, amyL, pstS, sacB, pSPAC, pAprE, pVeg, and pHpaII; and the promoter of the: *B. stearothermophilus* maltogenic amylase gene, *B. amyloliquefaciens* (BAN) amylase gene, *B. subtilis* alkaline protease gene, *B. clausii* alkaline protease gene, *B. pumilis* xylosidase gene, *B. thuringiensis* cryIIIA, and *B. licheniformis* alpha-amylase gene. Additional promoters include, but are not limited to, A4, phage Lambda $P_R$ or $P_L$, and *E. coli* lac, trp or tac.

One or more subtilisin variant described herein can be produced in host cells of any suitable Gram-positive microorganism, including bacteria and fungi. In some embodiments, the host strain is a recombinant strain, wherein a polynucleotide encoding the polypeptide of interest has been introduced into the host. For example, in some embodiments, one or more subtilisin variant described herein is produced in host cells of fungal and/or bacterial origin. In some embodiments, the host cells are *Bacillus* sp., *Streptomyces* sp., *Escherichia* sp. or *Aspergillus* sp. In some embodiments, the one or more subtilisin variant is produced by *Bacillus* sp. host cells. Examples of *Bacillus* sp. host cells include, but are not limited to, e.g., *B. licheniformis*, *B. lentus*, *B. subtilis*, *B. amyloliquefaciens*, *B. lentus*, *B. brevis*, *B. stearothermophilus*, *B. alkalophilus*, *B. coagulans*, *B. circulans*, *B. pumilis*, *B. thuringiensis*, *B. clausii*, and *B. megaterium*. Exemplary *Bacillus* host strains that can be used to produce one or more subtilisin variant described herein are set forth in USPNs 5,264,366 and 4,760,025 (RE 34,606).

In some embodiments, *B. subtilis* host cells are used for production of the one or more subtilisin variant described herein. Numerous *B. subtilis* strains are known, including, but not limited to, e.g., 1A6 (ATCC 39085), 168 (1A01), SB19, W23, Ts85, B637, PB1753 through PB1758, PB3360, JH642, 1A243 (ATCC 39,087), ATCC 21332, ATCC 6051, M1113, DE100 (ATCC 39,094), GX4931, PBT 110, and PEP 211strain. See e.g., Hoch et al., Genetics 73:215-228 (1973); Palva et al., Gene 19:81-87 (1982); Fahnestock and Fischer, J. Bacteriol., 165:796-804 (1986); and Wang et al., Gene 69:39-47 (1988)). See also, USPNs 4,450,235 and 4,302,544 and EP0134048).

In some embodiments, the *Bacillus* host cell is a *Bacillus* sp. that includes a mutation or deletion in one or more of the following genes degU, degS, degR and degQ. In one embodiment, the mutation is in a degUgene, and in another embodiment the mutation is degU(Hy)32. See e.g., Msadek et al., J. Bacteriol. 172:824-834 (1990) and Olmos et al., Mol. Gen. Genet. 253:562-567 (1997). In some embodiments, the *Bacillus* host comprises a mutation or deletion in scoC4, (see e.g., Caldwell et al., J. Bacteriol. 183:7329-7340 (2001)); spoiiE (see e.g., Arigoni et al., Mol. Microbiol. 31:1407-1415 (1999)); and/or oppA or other genes of the opp operon (see e.g., Perego et al., Mol. Microbiol. 5:173-185 (1991)). In some embodiments, these mutations occur alone, while in other embodiments, combinations of mutations are present. In addition, *Bacillus* sp. host cells that comprise mutation(s) and/or deletions of endogenous protease genes find use.

Suitable methods for introducing one or more nucleic acid or polynucleotide sequence described herein into *Bacillus* cells is described, for example in Ferrari et al., "Genetics," in Harwood et al. (ed.), *Bacillus*, Plenum Publishing Corp. (1989); Saunders et al., J. Bacteriol., 157:718-726 (1984); Hoch et al., J. Bacteriol., 93:1925-1937(1967); Mann et al., Current Microbiol., 13:131-135(1986); and Holubova, Folia, Microbiol., 30:97(1985); Chang et al., Mol. Gen. Genet., 168:11-115(1979); Vorobjeva et al., FEMS Microbiol. Lett., 7:261-263(1980); Smith et al., Appl. Env. Microbiol., 51:634(1986); Fisher et al., Arch. Microbiol., 139:213-217(1981); and McDonald, J., Gen. Microbiol., 130:203 (1984). Such suitable methods include, for example, protoplast transformation and congression, transduction, and protoplast fusion. For example, transformation methods can be used to introduce a DNA construct or vector comprising a nucleic acid encoding a subtilisin described herein into a host cell. Exemplary transformation methods include plasmid marker rescue transformation, which involves the uptake of a donor plasmid by competent cells carrying a partially homologous resident plasmid. Such methods are described, for example, in Contente et al., Plasmid 2:555-571 (1979); Haima et al., Mol. Gen. Genet. 223:185-191 (1990); Weinrauch et al., J. Bacteriol. 154:1077-1087 (1983); and Weinrauch et al., J. Bacteriol. 169:1205-1211 (1987).

In some embodiments, host cells are directly transformed with a DNA construct or vector comprising a nucleic acid encoding a subtilisin variant described herein (i.e., an intermediate cell is not used to amplify, or otherwise process, the DNA construct or vector prior to introduction into the host cell). Introduction of a DNA construct or vector described herein into the host cell includes physical and chemical methods known in the art to introduce a nucleic acid sequence into a host cell without insertion into a plasmid or vector. Such methods include, but are not limited to, for example, calcium chloride precipitation, electroporation, naked DNA, and liposomes. In additional embodiments, a DNA construct or vector is co-transformed with a plasmid, without being inserted into the plasmid. In further embodiments, a selective marker is deleted from the altered *Bacillus* strain by methods known in the art (see, e.g., Stahl et al., J. Bacteriol. 158:411-418 (1984) and Palmeros et al., Gene 247:255-264 (2000)).

In some embodiments, one or more transformed cell described herein is cultured in conventional nutrient media under culture conditions permitting the expression of one or more subtilisin variant described herein. In further embodiments, the one or more subtilisin variant expressed by the host cells is recovered from the cell culture. Another embodiment is directed to a method of producing one or more subtilisin variant described herein comprising cultivating a recombinant host cell in a culture medium comprising a recombinant expression vector comprising a nucleic acid encoding a subtilisin variant described herein under conditions conducive to producing said variant, and recovering said variant from the culture medium. Suitable culture conditions for producing one or more variant described herein, such as temperature, pH, etc are known to those skilled in the art. Exemplary culture conditions are described in, for example, Hopwood (2000) "Practical *Streptomyces* Genetics", John Innes Foundation, Norwich UK; and Hardwood et al., "Molecular Biological Methods for *Bacillus*", John Wiley (1990). Another embodiment provides one or more culture (e.g., cell culture) comprising one or more subtilisin variant or nucleic acid sequence described herein.

The medium used to culture the cells may comprise any conventional medium suitable for growing host cells, such as minimal or complex media containing appropriate supplements. Suitable media are available from commercial suppliers or may be prepared according to published recipes (e.g., in catalogues of the American Type Culture Collection (ATCC)). In some embodiments, one or more subtilisin variant described herein is secreted into the culture medium. In other embodiments, the subtilisin variant is recovered from the culture medium by conventional procedures, including, but not limited to, e.g., separating the cells from the medium by centrifugation or filtration; precipitating the proteinaceous components of the supernatant or filtrate by means of a salt (e.g., ammonium sulfate); and chromatographic purification (e.g., ion exchange, gel filtration, affinity, etc.).

In a further embodiment, a vector or DNA construct described herein may further comprise a nucleic acid sequence encoding a purification facilitating domain to facilitate purification of the subtilisin variant (see, e.g., Kroll, D. J. et al., DNA Cell Biol., 12:441-53 (1993)). Such purification facilitating domains include, but are not limited to, e.g., metal chelating peptides such as histidine-tryptophan modules that allow purification on immobilized metals (Porath J., Protein Expr. Purif, 3:263-281 (1992)), protein A domains that allow purification on immobilized immunoglobulin, and the domain utilized in the FLAGS extension/affinity purification system (Immunex Corp., Seattle, WA). The inclusion of a cleavable linker sequence such as Factor XA or enterokinase (Invitrogen, San Diego, CA) between the purification domain and the heterologous protein also find use to facilitate purification.

In one embodiment, the one or more subtilisin variant is useful in cleaning applications, such as, e.g., but not limited to, cleaning dishware items, tableware items, fabrics, and items having hard surfaces (e.g., the hard surface of a table, table top, wall, furniture item, floor, and ceiling). Another embodiment is directed to a composition comprising one or more subtilisin variant described herein with the proviso that the composition is not an automatic dishwashing composition. In some embodiments, the composition is a cleaning composition with the proviso that the composition is not an automatic dishwashing composition. In other embodiments, the composition is a detergent composition with the proviso that the composition is not an automatic dishwashing composition. In yet other embodiments, the composition is selected from a laundry detergent composition, an automatic dishwashing composition, a hand (manual) dishwashing detergent composition, a hard surface cleaning composition, an eyeglass cleaning composition, and a personal care composition. In still other embodiments, the composition is a laundry detergent composition, an automatic dishwashing composition, or a hand (manual) dishwashing detergent composition. In even still other embodiments, the composition is a laundry detergent composition or a hand (manual) dishwashing detergent composition. In some embodiments, the composition comprises one or more subtilisin variant described herein and one or more of an excipient; adjunct material; and/or additional enzyme.

Exemplary laundry detergent compositions include, but are not limited to, for example, liquid and powder laundry detergent compositions. Exemplary hard surface cleaning compositions include, but not limited to, for example, compositions used to clean the hard surface of a non-dishware item, non-tableware item, table, table top, furniture item, wall, floor, and ceiling. Exemplary hard surface cleaning compositions are described, for example, in U.S. Pat. Nos. 6,610,642, 6,376,450, and 6,376,450. Exemplary personal care compositions include, but are not limited to, compositions used to clean dentures, teeth, hair, contact lenses, and skin. Exemplary components of such oral care composition include those described in, for example, U.S. Pat. No. 6,376,450.

Unless otherwise noted, all component or composition levels provided herein are made in reference to the active level of that component or composition, and are exclusive of impurities, for example, residual solvents or by-products, which may be present in commercially available sources. Enzyme component weights are based on total active protein. All percentages and ratios are calculated by weight unless otherwise indicated. All percentages and ratios are calculated based on the total composition unless otherwise indicated.

Exemplary adjunct materials include, but are not limited to one or more alkalinity source, anti-tarnish and/or anti-corrosion agent, anti-caking agent, anti-oxidant, anti-redeposition agent, anti-shrinkage agent, anti-wrinkle agent, bleaching agent, bleach activator, bleach booster, bleach catalyst, bluing agent, brightener, builder, carrier, catalytic material, chelating agent, clay soil removal agent, colorant, color speckle, deposition aides, dispersant, dye, dye transfer inhibiting agent, enzyme activator, enzyme stabilizer, fabric conditioner, fabric softener, filler, fluorescer, fungicide, germicide, hydrogen peroxide, hydrolyzable surfactant, hydrotrope, lime soap dispersant, masking agent, optical brightener, organic polymeric compounds, perfume, pH control agent, photoactivator, pigment, polymeric dispersing agent, preservative, processing aid, rinse aid, silvercare, soil release polymer, soil suspension agent, solubilizing agent, solvent, sources of hydrogen peroxide, structure elasticizing agent, suds suppressor, and surfactant. Exemplary adjunct materials are described, for example, in U.S. Pat. Nos. 6,610,642; 6,605,458; 6,326,348; 6,306,812; 5,705,464; 5,710,115; 5,698,504; 5,695,679; 5,686,014; 5,646,101; and 5,576,282. If an adjunct material is not compatible with a subtilisin variant described herein, a suitable method of keeping the adjunct material and subtilisin variant separated (i.e., not in contact with one another) until combination of the two components is appropriate is used. Exemplary separation methods include, but are not limited to, for example, gelcaps, encapsulation, tablets, and physical separation.

Exemplary fillers or carriers for granular compositions include, but are not limited to, for example, various salts of sulfate, carbonate and silicate; talc; and clay. Exemplary fillers or carriers for liquid compositions include, but are not limited to, for example, water or low molecular weight primary and secondary alcohols including polyols and diols (e.g., methanol, ethanol, propanol and isopropanol). In some embodiments, the compositions contain from about 5% to about 90% of such filler or carrier. Acidic fillers may be included in such compositions to reduce the pH of the resulting solution in the cleaning method or application.

In another embodiment, one or more composition described herein is in a form selected from gel, tablet, powder, granular, solid, liquid, unit dose, and combinations thereof. In some embodiments, the cleaning composition describe herein is in a unit dose form. In other embodiments, the unit does form is selected from tablets, capsules, sachets, pouches, and multi-compartment pouches. In some embodiments, the unit dose format is designed to provide controlled release of the ingredients within a multi-compartment pouch (or other unit dose format). Suitable unit dose and controlled release formats are described, for example, in EP 2100949; WO 02/102955; U.S. Pat. Nos. 4,765,916; 4,972,017; and WO 04/111178. In some embodiments, the unit dose form is a tablet or powder contained in a water-soluble film or pouch.

In some embodiments, one or more subtilisin variant described herein cleans at low temperatures. In other embodiments, one or more composition described herein cleans at low temperatures. In other embodiments, one or more composition described herein comprises an effective amount of one or more subtilisin variant described herein as useful or effective for cleaning a surface in need of proteinaceous stain removal In one embodiment, one or more cleaning composition described herein comprises an effective amount of one or more subtilisin variant described herein, alone or in combination with one or more additional enzyme. Typically, a cleaning composition comprises at least about 0.0001 to about 20 wt %, from about 0.0001 to about 10 wt %, from about 0.0001 to about 1 wt %, from about 0.001 to about 1 wt %, or from about 0.01 to about 0.1 wt % of one or more protease. In another embodiment, one or more cleaning composition described herein comprises from about 0.01 to about 10 mg, about 0.01 to about 5 mg, about 0.01 to about 2 mg, about 0.01 to about 1 mg, about 0.5 to about 10 mg, about 0.5 to about 5 mg, about 0.5 to about 4 mg, about 0.5 to about 4 mg, about 0.5 to about 3 mg, about 0.5 to about 2 mg, about 0.5 to about 1 mg, about 0.1 to about 10 mg, about 0.1 to about 5 mg, about 0.1 to about 4 mg, about 0.1 to about 3 mg, about 0.1 to about 2 mg, about 0.1 to about 2 mg, about 0.1 to about 1 mg, or about 0.1 to about 0.5 mg of one or more protease per gram of composition.

The cleaning compositions described herein can be formulated such that when used in aqueous conditions, the wash water has a pH of from about 5.0 to about 11.5 or even from about 7.5 to about 10.5. Liquid compositions are typically formulated to have a neat pH from about 3.0 to about 9.0 or from about 3.0 to about 5.0. Granular laundry compositions are typically formulated to have a pH from about 9 to about 11. Hand dishwashing detergent compositions are typically formulated to have a pH from about 8 to about 11.5, including, but not limited to, e.g., pH ranges of about 8 to about 10, from about 9 to about 11.5, and from about 9.5 to about 11.5. Techniques for controlling pH at recommended usage levels include, for example, using buffers, alkalis, and acids. Cleaning compositions with a neat pH of from about 3 to about 5 are typically free of surfactants that hydrolyze in such a pH environment. Low pH compositions typically comprise a sufficient amount of a pH modifier (e.g., sodium hydroxide, monoethanolamine, or hydrochloric acid) and one or more acid stable enzyme.

Exemplary surfactant and/or surfactant systems include, but are not limited to, nonionic surfactants, anionic surfactants, cationic surfactants, ampholytic surfactants, zwitterionic surfactants, semi-polar nonionic surfactants, and mixtures thereof. Low pH cleaning compositions (e.g., neat pH of from about 3 to about 5) typically do not contain alkyl ethoxylated sulfate, as it is believed that such surfactant may be hydrolyzed by such compositions. In some embodiments, the surfactant is present at a level of from about 0.10% to about 60%, while in alternative embodiments the level is from about 1% to about 50%, while in still further embodiments the level is from about 5% to about 40%, by weight of the cleaning composition.

In some embodiments, the subtilisin variant described herein is encapsulated to protect it during storage from the other components in the cleaning composition. In some embodiments, the encapsulating material encapsulates at least part of the catalyst for the subtilisin variant described herein. Typically, the encapsulating material is water-soluble and/or water-dispersible. In some embodiments, the encapsulating material has a glass transition temperature (Tg) of 0° C. or higher. Exemplary encapsulating material includes, but is not limited to, carbohydrates, natural or synthetic gums, chitin, chitosan, cellulose and cellulose derivatives, silicates, phosphates, borates, polyvinyl alcohol, polyethylene glycol, paraffin waxes, and combinations thereof. When the encapsulating material is a carbohydrate, it is typically selected from monosaccharides, oligosaccharides, polysaccharides, and combinations thereof. In some typical embodiments, the encapsulating material is a starch (see, e.g., EP 0922499; U.S. Pat. Nos. 4,977,252; 5,354,559; and 5,935,826). In some embodiments, the encapsulating material is a microsphere made from plastic such as thermoplastics, acrylonitrile, methacrylonitrile, polyacrylonitrile, polymethacrylonitrile and mixtures thereof. Exemplary commercial microspheres include, but are not limited to EXPANCEL® (Akzo Nobel Chemicals International, B.V.); PM6545, PM6550, PM7220, PM7228, and EXTENDOSPHERES® (Sphere One Inc.); and LUXSIL®, Q-CEL®, and SPHERICEL® (Potters Industries LLC).

A further embodiment is directed to a method of cleaning an item or surface in need of cleaning, wherein the method comprises contacting the item or surface with one or more subtilisin variant or one or more composition described herein. In yet a further embodiment, the method of cleaning is conducted at a low temperature or a low pH. In an even still further embodiment, the item or surface in need of cleaning is cleaned. Some such methods further comprise rinsing the item or surface with water. In some embodiments, the item or object to be cleaned is a dishware item (e.g., a dish, plate, cup, or bowl) or tableware item (e.g., dishes, cutlery, knives, forks, spoons, chopsticks, glassware, pitchers, sauce boats, and drinking vessels).

An even further embodiment is directed to a cold water washing method comprising contacting an item or surface in need of cleaning with one or more subtilisin variant or one or more composition described herein, wherein said item or surface is washed at temperature of from about 10° C. to about 40° C., and wherein said item or surface is cleaned. In some embodiments, the "cold water washing" described herein utilizes temperatures of from about 10° C. to about 40° C., or from about 20° C. to about 30° C., or from about 15° C. to about 25° C., as well as all other combinations within the range of about 15° C. to about 35° C., and all ranges within 10° C. to 40° C. A still yet further embodiment is directed to a method of cleaning an item or surface in need of cleaning, wherein the method comprises contacting the item or surface with one or more subtilisin variant or one or more composition described herein and water, wherein said water has a hardness selected from 1-19 gpg, 1-7 gpg; and 7-19 gpg. In some instances, if desired, the method can be repeated one or more times, particularly if additional cleaning or washing is desired. For example, in some instance, the method optionally further comprises allowing the item or surface to remain in contact with the one or more subtilisin variant or composition described herein for a period of time sufficient or effective to clean or wash the item or surface to the desired degree. For purposes of the present invention, "washing" includes, but is not limited to, e.g., scrubbing and mechanical agitation.

A further embodiment is directed to a method of cleaning a laundry or fabric item in a washing machine, the method comprising providing a washing machine, placing an amount of a laundry detergent composition comprising one or more subtilisin variant described herein that is sufficient to clean the laundry or fabric item in the machine (e.g., by placing the composition in an appropriate or provided detergent compartment or dispenser), putting the laundry or fabric item in the machine, and operating the machine so as to clean the laundry or fabric item (e.g., as per the manufacturer's instructions).

Different geographies have different water hardness. Water hardness is usually described in terms of the grains per gallon ("gpg") mixed $Ca^{2+}/Mg^{2+}$. Hardness is a measure of the amount of calcium ($Ca^{2+}$) and magnesium ($Mg^{2+}$) in the water. Most water in the United States is hard, but the degree of hardness varies. Moderately hard (60-120 ppm) to hard (121-181 ppm) water has 60 to 181 ppm (ppm can be converted to grains per U.S. gallon by dividing ppm by 17.1) of hardness minerals.

| Water | Grains per gallon | Parts per million |
|---|---|---|
| Soft | less than 1.0 | less than 17 |
| Slightly hard | 1.0 to 3.5 | 17 to 60 |
| Moderately hard | 3.5 to 7.0 | 60 to 120 |
| Hard | 7.0 to 10.5 | 120 to 180 |
| Very hard | greater than 10.5 | greater than 180 |

European water hardness is typically greater than about 10.5 (e.g., about 10.5 to about 20.0) gpg mixed $Ca^{2+}/Mg^{2+}$ (e.g., about 15 gpg mixed $Ca^{2+}/Mg^{2++}$). North American water hardness is typically greater than Japanese water hardness, and less than European water hardness. For example, North American water hardness is generally between about 3 to about 10 gpg, about 3 to about 8 gpg, or about 6 gpg. Japanese water hardness is typically less than about 4 gpg (e.g., about 3 gpg mixed $Ca^{2+}/Mg^{2+}$).

A still yet further embodiment is directed to a composition comprising from about 0.00001% to about 10% by weight composition of one or more subtilisin variant described herein and from about 99.999% to about 90.0% by weight composition of one or more adjunct material. In another embodiment, the cleaning composition comprises from about 0.0001% to about 10%, about 0.001% to about 5%, about 0.001% oto about 2%, or about 0.005% to about 0.5% by weight composition of one or more subtilisin variant and from about 99.9999% to about 90.0%, about 99.999% to about 98%, about 99.995% to about 99.5% by weight composition of one or more adjunct material.

In other embodiments, the composition described herein comprises one or more subtilisin variant described herein and one or more additional enzyme. The one or more additional enzyme is selected from hemicellulases, cellulases, peroxidases, additional proteases, xylanases, lipases, phospholipases, esterases, cutinases, pectinases, pectate lyases, mannanases, keratinases, reductases, oxidases, phenoloxidases, lipoxygenases, ligninases, pullulanases, tannases, pentosanases, β-glucanases, arabinosidases, hyaluronidases, chondroitinases, laccases, amylases, metalloproteases, and mixtures thereof. In some embodiments, the composition described herein comprises one or more subtilisin variant described herein and one or more additional enzyme selected from additional protease, lipase, cutinase, mannanase, cellulase, and amylase.

In another embodiment, one or more composition described herein comprises one or more subtilisin variant described herein and one or more additional protease. In one embodiment, the additional protease is a serne protease. In another embodiment, the additional protease is an alkaline microbial protease or a trypsin-like protease. Exemplary alkaline proteases include subtilisins derived from, for example, *Bacillus* (e.g., *B. lentus* subtilisin (i.e., GG36), *B. amyloliquefaciens* subtilisin (i.e., BPN'), subtilisin Carlsberg, subtilisin 309, subtilisin 147, PB92, and subtilisin 1680). Exemplary additional proteases include, but are not limited to, for example, the commercial proteases MAXATASE, MAXACAL, MAXAPEM, OPTICLEAN®, OPTIMASE®, PROPERASE®, PURAFECT®, PURAFECT® OXP, PURAMAX®, EXCELLASE®, PREFERENZ™ proteases (e.g. P100, P110, P280), EFFECTENZ™ proteases (e.g. P1000, P1050, P2000), EXCELLENZ™ proteases (e.g. P1000), ULTIMASE®, and PURAFAST (Danisco US); ALCALASE®, ALCALASE® ULTRA, BLAZE®, BLAZE® EVITY®, BLAZE® EVITY® 16L, CORONASE®, SAVINASE®, SAVINASE® ULTRA, SAVINASE® EVITY®, SAVINASE® EVERIS®, PRIMASE, DURAZYM, POLARZYME®, OVOZYME®, KANNASE®, LIQUANASE®, EVERIS®, NEUTRASE®, PROGRESS UNO®, RELASE® and ESPERASE® (Novozymes); BLAP™ and BLAP™ variants (Henkel); LAVERGY™ PRO 104 L (BASF), and KAP® (*B. alkalophilus* subtilisin) (Kao). Exemplary additional proteases also include but are not limited to those described in, for example, WO95/23221, WO 92/21760, WO2008010925, WO20100566356, WO2011072099, WO201113022, WO2011140364, WO2012151534, WO2015038792, WO2015089441, WO2015089447, WO2015143360, WO2016001449, WO2016001450, WO2016061438, WO2016069544, WO2016069548, WO2016069552, WO2016069557, WO2016069563, WO2016069569, WO2016087617, WO2016087619, WO2016145428, WO2016174234, WO2016183509, WO2016202835, WO2016205755, US 2008/0090747, U.S. Pat. Nos. 5,801,039, 5,340,735, 5,500,364, 5,855,625, RE 34,606, U.S. Pat. Nos. 5,955,340, 5,700,676, 6,312,936, 6,482,628, 8,530,219; U.S. Provisional Appl Nos. 62/331,282, 62/343,618, 62/351,649, 62/437,171, 62/437,174, and 62/437,509; and PCT Appl No. PCT/CN2017/076749, as well as metalloproteases described in WO 2007/044993, WO 2009/058303, WO 2009/058661, WO 2014/071410, WO 2014/194032, WO 2014/194034, WO 2014/194054, and WO 2014/194117. Exemplary additional proteases include, but are not limited to trypsin (e.g., of porcine or bovine origin) and the *Fusarium* protease described in WO 89/06270.

Another embodiment is directed to a composition comprising one or more subtilisin variant described herein and one or more lipase. In some embodiments, the composition comprises from about 0.00001% to about 10%, about 0.0001% to about 10%, about 0.001% to about 5%, about 0.001% to about 2%, or about 0.005% to about 0.5% lipase by weight composition. An exemplary lipase can be a chemically or genetically modified mutant. Exemplary lipases include, but are not limited to, e.g., those of bacterial or fungal origin, such as, e.g., *H. lanuginosa* lipase (see, e.g., EP 258068 and EP 305216), *T. lanuginosus* lipase (see, e.g., WO2014/059360 and WO2015/010009), *Rhizomucor miehei* lipase (see, e.g., EP 238023), *Candida* lipase, such as *C. antarctica* lipase (e.g., *C. antarctica* lipase A or B) (see, e.g., EP 214761), *Pseudomonas* lipases such as *P. alcaligenes* lipase and *P. pseudoalcaligenes* lipase (see, e.g., EP 218272), *P. cepacia* lipase (see, e.g., EP 331376), *P. stutzeri* lipase (see, e.g., GB 1,372,034), *P. fluorescens* lipase, *Bacillus* lipase (e.g., *B. subtilis* lipase (Dartois et al., Biochem. Biophys. Acta 1131:253-260 (1993)); *B. stearothermophilus* lipase (see, e.g., JP 64/744992); and *B. pumilus* lipase (see, e.g., WO 91/16422)). Other lipolytic enzymes, such as cutinases, may also find use in one or more composition describe herein, including, but not limited to, e.g., cutinase derived from *Pseudomonas mendocina* (see, WO 88/09367) and cutinase derived from *Fusarium solani pisi* (see, WO 90/09446). Exemplary commercial lipases include, but are not limited to M1 LIPASE, LUMA FAST, and LIPOMAX (Genencor); LIPEX®, LIPOCLEAN®, LIPOLASE® and LIPOLASE® ULTRA (Novozymes); and LIPASE P (Amano Pharmaceutical Co. Ltd).

A still further embodiment is directed to a composition comprising one or more subtilisin variant described herein and one or more amylase. In one embodiment, the composition comprises from about 0.00001% to about 10%, about 0.0001% to about 10%, about 0.001% to about 5%, about 0.0010% to about 2%, or about 0.005% to about 0.5% amylase by weight composition. Any amylase (e.g., alpha and/or beta) suitable for use in alkaline solutions may be useful to include in such composition. An exemplary amylase can be a chemically or genetically modified mutant. Exemplary amylases include, but are not limited to those of bacterial or fungal origin, such as, for example, amylases described in GB 1,296,839, WO91/00353, WO94/02597, WO94/183314, WO95/10603, WO95/26397, WO95/35382, WO 96/05295, WO96/23873, WO96/23874, WO96/30481, WO97/10342, WO97/41213, WO97/43424, WO 98/13481, WO98/26078, WO99/02702, WO99/09183, WO99/19467, WO99/23211, WO99/29876, WO 99/42567, WO99/43793, WO99/43794, WO99/46399, WO00/29560, WO00/60058, WO00/60059, WO 00/60060, WO01/14532, WO01/34784, WO01/64852, WO01/66712, WO01/88107, WO01/96537, WO 02/092797, WO02/10355, WO02/31124, WO2004055178, WO2004113551, WO2005001064, WO 2005003311, WO2005018336, WO2005019443, WO2005066338, WO2006002643, WO2006012899, WO2006012902, WO2006031554, WO2006063594, WO2006066594, WO2006066596, WO 2006136161, WO2008000825, WO2008088493, WO2008092919, WO2008101894, WO2008112459, WO2009061380, WO2009061381, WO2009100102, WO2009140504, WO2009149419, WO 2010059413, WO2010088447, WO2010091221, WO2010104675, WO2010115021, WO2010115028, WO2010117511, WO2011076123, WO2011076897, WO2011080352, WO2011080353, WO 2011080354, WO2011082425, WO2011082429, WO2011087836, WO2011098531, WO2013063460, WO2013184577, WO2014099523, WO2014164777, and WO2015077126. Exemplary commercial amylases include, but are not limited to AMPLIFY®, AMPLIFY PRIME®, BAN DURAMYL®, TERMAMYL®, TERMAMYL® ULTRA, FUNGAMYL®, STAINZYME®, STAINZYME® PLUS, STAINZYME® ULTRA, and STAINZYME® EVITY® (Novozymes); EFFECTENZ™ S 1000, POWERASE®, PREFERENZ™ S 100, PREFERENZ™ S 110, EXCELLENZ™ S 2000, RAPIDASE® and MAXAMYL® P (Danisco US).

Yet a still further embodiment is directed to a composition comprising one or more subtilisin variant described herein and one or more cellulase. In one embodiment, the composition comprises from about 0.00001% to about 10%, 0.0001% to about 10%, about 0.001% to about 5%, about 0.001% to about 2%, or about 0.005% to about 0.5% cellulase by weight of composition. Any suitable cellulase may find used in a composition described herein. An exemplary cellulase can be a chemically or genetically modified mutant. Exemplary cellulases include but are not limited, to those of bacterial or fungal origin, such as, for example, is described in WO2005054475, WO2005056787, U.S. Pat. Nos. 7,449,318, 7,833,773, 4,435,307; EP 0495257; U.S. Provisional Appl. No. 62/435,340; and PCT Appl No. PCT/US16/67223. Exemplary commercial cellulases include, but are not limited to, CELLUCLEAN®, CELLUZYME®, CAREZYME®, CAREZYME® PREMIUM, ENDOLASE®, and RENOZYME® (Novozymes); REVITALENZ®100, REVITALENZ® 200/220 and REVITALENZ® 2000 (Danisco US); and KAC-500(B) (Kao Corporation). In some embodiments, cellulases are incorporated as portions or fragments of mature wild-type or variant cellulases, wherein a portion of the N-terminus is deleted (see, e.g., U.S. Pat. No. 5,874,276).

An even still further embodiment is directed to a composition comprising one or more subtilisin variant described herein and one or more mannanase. In one embodiment, the composition comprises from about 0.00001% to about 10%, about 0.0001% to about 10%, about 0.001% to about 5%, about 0.001% to about 2%, or about 0.005% to about 0.5% mannanase by weight composition. An exemplary mannanase can be a chemically or genetically modified mutant. Exemplary mannanases include, but are not limited to, those of bacterial or fungal origin, such as, for example, as is described in WO2016007929; USPNs 6566114, 6602842, and 6440991; and International Appl Nos. PCT/US2016/060850 and PCT/US2016/060844. Exemplary commercial mannanases include, but are not limited to MANNAWAY®

(Novozymes); and EFFECTENZ™ M 1000, PREFERENZ® M 100, MANNASTAR®, and PURABRITE (Danisco US).

A yet even still further embodiment is directed to a composition comprising one or more subtilisin variant described herein and one or more peroxidase and/or oxidase enzyme. In one embodiment, the composition comprises from about 0.00001% to about 10%, about 0.0001% to about 10%, about 0.001% to about 5%, about 0.001% to about 2%, or about 0.005% to about 0.5% peroxidase or oxidase by weight composition. A peroxidase may be used in combination with hydrogen peroxide or a source thereof (e.g., a percarbonate, perborate or persulfate) and an oxidase may be used in combination with oxygen. Peroxidases and oxidases are used for "solution bleaching" (i.e., to prevent transfer of a textile dye from a dyed fabric to another fabric when the fabrics are washed together in a wash liquor), alone or in combination with an enhancing agent (see, e.g., WO 94/12621 and WO 95/01426). An exemplary peroxidase and/or oxidase can be a chemically or genetically modified mutant. Exemplary peroxidases/oxidases include, but are not limited to those of plant, bacterial, or fungal origin.

Another embodiment is directed to a composition comprising one or more subtilisin variant described herein and one or more one or more perhydrolase, such as, for example, is described in WO 2005056782, WO2007106293, WO2008063400, WO2008106214, and WO2008106215.

In yet another embodiment, the subtilisin variant described herein and one or more additional enzyme contained in one or more composition described herein may each independently range to about 10%, wherein the balance of the cleaning composition is one or more adjunct material.

In some embodiments, one or more composition described herein finds use as a detergent additive, wherein said additive is in a solid or liquid form. Such additive products are intended to supplement and/or boost the performance of conventional detergent compositions and can be added at any stage of the cleaning process. In some embodiments, the density of the laundry detergent composition ranges from about 400 to about 1200 g/liter, while in other embodiments it ranges from about 500 to about 950 g/liter of composition measured at 20° C.

Other embodiments are directed to one or more composition described herein, wherein said composition is a compact granular fabric cleaning composition that finds use in laundering colored fabrics or provides softening through the wash capacity, or is a heavy duty liquid (HDL) fabric cleaning composition. Exemplary fabric cleaning compositions are described in USPNs 6,610,642 and 6,376,450. Exemplary granular laundry detergent compositions of use in European or Japanese washing condition are described in U.S. Pat. No. 6,610,642. Other exemplary cleaning compositions are described, for example, in U.S. Pat. Nos. 6,376, 445; 6,294,514; 5,929,022; 5,879,584; 5,691,297; 5,565, 145; 5,574,005; 5,569,645; 5,565,422; 5,516,448; 5,489, 392; and U.S. Pat. Nos. 5,486,303; 4,968,451; 4,597,898; 4,561,998; 4,550,862; 4,537,706; 4,515,707; and 4,515,705.

In some embodiments, one or more composition described herein comprises one or more detergent builders or builder systems. In one embodiment, the composition comprises from about 1%, from about 3% to about 60% or even from about 5% to about 40% builder by weight composition. Exemplary builders include, but are not limited to, for example, alkali metal, ammonium and alkanolammonium salts of polyphosphates; alkali metal silicates; alkaline earth and alkali metal carbonates; aluminosilicates; polycarboxylate compounds; ether hydroxypolycarboxylates; copolymers of maleic anhydride with ethylene or vinyl methyl ether, 1, 3, 5-trihydroxy benzene-2, 4, 6-trisulphonic acid, and carboxymethyloxysuccinic acid; the various alkali metal; ammonium and substituted ammonium salts of polyacetic acids, such as, ethylenediamine tetraacetic acid and nitrilotriacetic acid, as well as polycarboxylates, such as mellitic acid, succinic acid, citric acid, oxydisuccinic acid, polymaleic acid, benzene 1,3,5-tricarboxylic acid, carboxymethyloxysuccinic acid; and soluble salts thereof. In some such compositions, the builders form water-soluble hardness ion complexes (e.g., sequestering builders), such as citrates and polyphosphates, e.g., sodium tripolyphosphate, sodium tripolyphospate hexahydrate, potassium tripolyphosphate, and mixed sodium and potassium tripolyphosphate. Exemplary builders are described in, e.g., EP 2100949.

In some embodiments, one or more composition described herein comprises one or more chelating agent. In one embodiment, the composition comprises from about 0.1% to about 15% or about 3% to about 10% chelating agent by weight composition. Exemplary chelating agents include, but are not limited to, e.g., copper, iron, manganese, and mixtures thereof.

In some embodiments, one or more composition described herein comprises one or more deposition aid. Exemplary deposition aids include, but are not limited to, e.g., polyethylene glycol; polypropylene glycol; polycarboxylate; soil release polymers, such as, e.g., polytelephthalic acid; clays such as, e.g., kaolinite, montmorillonite, atapulgite, illite, bentonite, and halloysite; and mixtures thereof.

In other embodiments, one or more composition described herein comprises one or more anti-redeposition agent or non-ionic surfactant (which can prevent the re-deposition of soils) (see, e.g., EP 2100949).

In some embodiments, one or more composition described herein comprises one or more dye transfer inhibiting agent. Exemplary polymeric dye transfer inhibiting agents include, but are not limited to, polyvinylpyrrolidone polymers, polyamine N-oxide polymers, copolymers of N-vinylpyrrolidone and N-vinylimidazole, polyvinyloxazolidones, polyvinylimidazoles, and mixtures thereof. In one embodiment, the composition comprises from about 0.0001% to about 10%, about 0.01% to about 5%, or about 0.1% to about 3% dye transfer inhibiting agent by weight composition.

In some embodiments, one or more composition described herein comprises one or more silicate. Exemplary silicates include, but are not limited to, sodium silicates, e.g., sodium disilicate, sodium metasilicate, and crystalline phyllosilicates. In some embodiments, silicates are present at a level of from about 1% to about 20% or about 5% to about 15% by weight of the composition.

In some still additional embodiments, one or more composition described herein comprises one or more dispersant. Exemplary water-soluble organic materials include, but are not limited to, e.g., homo- or co-polymeric acids or their salts, in which the polycarboxylic acid comprises at least two carboxyl radicals separated from each other by not more than two carbon atoms.

In some further embodiments, one or more composition described herein comprises one or more enzyme stabilizer. In some embodiments, the enzyme stabilizer is water-soluble sources of calcium and/or magnesium ions. In some embodiments, the enzyme stabilizers include oligosaccharides, polysaccharides, and inorganic divalent metal salts, including alkaline earth metals, such as calcium salts. In some embodiments, the enzymes employed herein are stabilized by the presence of water-soluble sources of zinc (II), calcium (II) and/or magnesium (II) ions in the finished compositions that provide such ions to the enzymes, as well as other metal ions (e.g., barium (II), scandium (II), iron (II), manganese (III), aluminum (III), tin (II), cobalt (II), copper (II), nickel (II), and oxovanadium (IV)). Chlorides and sulfates also find use in some embodiments of the present invention. Exemplary oligosaccharides and polysaccharides (e.g., dextrins) are described, for example, in WO 07/145964. In some embodiments, reversible protease inhibitors also find use, such as boron-containing compounds (e.g., borate, 4-formyl phenyl boronic acid) and/or tripeptide aldehydes.

In some embodiments, one or more composition described herein comprises one or more bleach, bleach activator, and/or bleach catalyst. In some embodiments, one or more composition described herein comprises one or more inorganic and/or organic bleaching compound. Exemplary inorganic bleaches include, but are not limited to perhydrate salts, e.g., perborate, percarbonate, perphosphate, persulfate, and persilicate salts. In some embodiments, inorganic perhydrate salts are alkali metal salts. In some embodiments, inorganic perhydrate salts are included as the crystalline solid, without additional protection, although in some other embodiments, the salt is coated. Bleach activators are typically organic peracid precursors that enhance the bleaching action in the course of cleaning at temperatures of 60° C. and below. Exemplary bleach activators include compounds which, under perhydrolysis conditions, give aliphatic peroxoycarboxylic acids having from about 1 to about 10 carbon atoms or about 2 to about 4 carbon atoms, and/or optionally substituted perbenzoic acid. Exemplary bleach activators ae described, for example, in EP 2100949). Exemplary bleach catalysts include, but are not limited to, manganese triazacyclononane and related complexes, as well as cobalt, copper, manganese, and iron complexes. Additional exemplary bleach catalysts are described, for example, in U.S. Pat. Nos. 4,246,612; 5,227,084; 4,810,410; WO 99/06521; and EP 2100949.

In some embodiments, one or more composition described herein comprises one or more catalytic metal complexes. In some embodiments, a metal-containing bleach catalyst finds use. In some embodiments, the metal bleach catalyst comprises a catalyst system comprising a transition metal cation of defined bleach catalytic activity (e.g., copper, iron, titanium, ruthenium, tungsten, molybdenum, or manganese cations), an auxiliary metal cation having little or no bleach catalytic activity (e.g., zinc or aluminum cations), and a sequestrate having defined stability constants for the catalytic and auxiliary metal cations, particularly ethylenediaminetetraacetic acid, ethylenediaminetetra (methylenephosphonic acid) and water-soluble salts thereof (see, e.g., U.S. Pat. No. 4,430,243). In some embodiments, one or more composition described herein is catalyzed by means of a manganese compound. Such compounds and levels of use are described, for example, in U.S. Pat. No. 5,576,282. In additional embodiments, cobalt bleach catalysts find use and are included in one or more composition described herein. Various cobalt bleach catalysts are described, for example, in USPNs 5,597,936 and 5,595,967.

In some additional embodiments, one or more composition described herein includes a transition metal complex of a macropolycyclic rigid ligand (MRL). As a practical matter, and not by way of limitation, in some embodiments, the compositions and cleaning processes described herein are adjusted to provide on the order of at least one part per hundred million, from about 0.005 ppm to about 25 ppm, about 0.05 ppm to about 10 ppm, or about 0.1 ppm to about 5 ppm of active MRL in the wash liquor.

Exemplary MRLs include, but are not limited to special ultra-rigid ligands that are cross-bridged, such as, e.g., 5,12-diethyl-1,5,8,12-tetraazabicyclo(6.6.2)hexadecane. Exemplary metal MRLs are described, for example, in WO 2000/32601 and U.S. Pat. No. 6,225,464.

In another embodiment, one or more composition described herein comprises one or more metal care agent. In some embodiments, the composition comprises from about 0.1% to about 5% metal care agent by weight composition. Exemplary metal care agents include, for example, aluminum, stainless steel, and non-ferrous metals (e.g., silver and copper). Additional exemplary metal care agents are described, for example, in EP 2100949, WO 94/26860, and WO 94/26859. In some compositions, the metal care agent is a zinc salt.

In another embodiment, one or more composition described herein contains phosphate and/or boron. In yet another embodiment, one or more composition described herein does not contain phosphate or boron.

EXAMPLE 1

Methods

Performance Index

The performance index (PI) of an enzyme compares the performance of the variant (measured value) with the parent enzyme (theoretical value or measured value) at the same protein concentration. Theoretical concentrations for the parent enzyme can be calculated using the parameters extracted from a Langmuir fit of a standard curve of the parent enzyme. A PI that is greater than 1 (PI>1) indicates improved performance by a variant as compared to a parent or benchmark protease (defined for each analyzed data set), while a PI of 1 (PI=1) identifies a variant that performs the same as the parent, and a PI that is less than 1 (PI<1) identifies a variant that performs worse than the parent.

Protein Purification

Samples were dialyzed overnight against 25 mM MES, pH 5.4, 1 mM $CaCl_2$ buffer, and loaded on a 30 mL Source 15S column (GE Healthcare) equilibrated with the same buffer. A gradient of 0 to 150 mM NaCl was run, and fractions were collected. Fractions containing target protein were pooled, concentrated, and formulated with 40% Propylene Glycol, and sterile filtered.

HPLC Assay for Protein Determination

For high resolution concentration determinations, high performance liquid chromatography (HPLC) method was performed on protein samples. An Agilent 1100 HPLC equipped with an Agilent 300SB-C8 column was used for protein quantitation. Samples were eluted from the column using a gradient of 0.1% trifluoroacetic acid (TFA) in water and 0.1% TFA in acetonitrile. Absorbance was measured at 220 nm, and peaks were integrated using ChemStation software (Agilent Technologies, USA). The protein concentrations of the samples were calculated based on a standard curve of the purified GG36 protease variant designated JV0001 (SEQ ID NO: 14).

Protease Activity Assays

The protease activity of GG36 wild-type ("WT") (SEQ ID NO:1) ("Parent") and variants thereof was tested by measuring hydrolysis of dimethyl casein (DMC) or skim milk substrates or by measuring hydrolysis of N-succinyl-Ala-Ala-Pro-Phe p-nitroanilide (suc-AAPF-pNA) colorimetric substrate.

The reagent solutions used for the DMC assay were: 2.5% w/v DMC (Sigma C-9801) in 100 mM sodium carbonate buffer pH 9.5, 0.075% TNBSA (Thermo Scientific) in Reagent A. Reagent A: 45.4 g $Na_2B_4O_7 \cdot 10H_2O$ in 15 mL 4 N NaOH to reach a final volume of 1000 mL in deionized water. Protease supernatants were diluted in dilution solution: 10 mM NaCl, 0.1 mM $CaCl_2$, 0.005% Tween-80 to the desired concentration to achieve a linear response during hydrolysis over 3 min. A 384-well microtiter plate (MTP) was filled with 27 μl DMC substrate followed by the addition of 27 μl of TNBSA in Reagent A. 6 μL of 5 μl diluted protease supernatant was then added with slow mixing. Activity was measured at 405 nm over 3 min using a SpectraMax plate reader in kinetic mode at RT. The absorbance of a blank containing thermally inactivated protease was subtracted from each sample reading. The protease activity was expressed as mOD/min.

The reagent solutions used for the skim milk assay were: 40 mg/mL BD Difco skim milk powder in 100 mM Tris, 0.005% Tween-80, pH 8.6 with 10 gpg hardness. The solution was equilibrated for 1 h before use. Activity was measured at 650 nm over 3 min using a SpectraMax plate reader in kinetic mode at RT. Activity was expressed as mOD/min.

Protease activity was tested by measuring the hydrolysis of N-Succinyl-Ala-Ala-Pro-Phe p-nitroanilide (suc-AAPF-pNA, Sigma: S-7388) colorimetric substrate. The reagent solutions used were: 100 mM Tris-HCl pH 8.6, 0.005% Tween®-80 (Tris buffer) and 160 mM suc-AAPF-pNA in DMSO (suc-AAPF-pNA stock solution). Enzyme supernatants were diluted using a dilution solution (10 mM sodium chloride, 0.1 mM calcium chloride, 0.005% Tween®-80 and 0.02% sodium azide). To prepare a working substrate solution, 1 mL of suc-AAPF-pNA stock solution was added to 100 mL Tris buffer and mixed. A 384-well microtiter plate (MTP) was filled with 50 μL/well of the 1 mg/mL suc-AAPF-pNA working solution and aliquots (5 μL/well) of diluted enzyme supernatants were added to wells of this MTP with slow mixing. Activity was measured by reading absorbance at 405 nm over 3 min using a SpectraMax spectrophotometer plate reader in kinetic mode at room temperature. The absorbance of a blank containing thermally inactivated protease was subtracted from each sample reading. The protease activity was expressed as mOD/min and protease dilutions were targeted to give blank-corrected unstressed protease activities in the range of 5 to 300 mOD/min.

Cleaning Performance in ADW Detergent

Cleaning performance of the GG36 variants was tested relative to Parent using PAS-38 microswatches (egg yolk on polyacryl fabric, aged and colored with carbon black dye, purchased from Center for Testmaterials BV, Vlaardingen, Netherlands) as a read out for dish-based applications. Pre-punched (to fit on MTP), rinsed, and filled swatch-containing MTPs (Corning 3641) were prepared by Center for Testmaterials BV. The cleaning performance of GG36 variants was evaluated under automatic dishwashing applications (ADW) using Composition A (set forth in Table 1 herein below) that was pH adjusted to 11 using 10 mM CAPS. PAS38 swatches were prepared by adding 180p 10 mM CAPS buffer of pH 11 to MTPs containing PAS38 microswatches. The MTPs were sealed and incubated in an iEMS incubator for 30 min at 60° C. and 1100 rpm shaking. After incubation, the buffer was removed and the plates were air dried prior to use in the performance assay. The MTPs were filled prior to enzyme addition with Composition A with 19 gpg water hardness (to represent very hard water conditions) for testing at 50° C. The MTPs were filled prior to enzyme addition with Composition A and Composition B with 7 gpg water hardness (to represent moderate water conditions) at 20° C. Water hardness was adjusted by using a stock solution of 15,000 gpg (3:1 Ca:Mg, 1.924 M $CaCl_2$ and 0.641 M $MgCl_2$). For the wash conditions, Composition A was diluted to a final concentration of 3.95 g/L for the wash tests and Composition B was diluted to a final concentration of 1 mL/L.

For the assay, 5-10 μL (10-20 ppm) of diluted enzyme solution was added to each well. The MTPs were sealed then incubated in IEMS shaker for 30 min at 20° C. or 50° C. Following incubation, 160 ul of supernatant was transferred to a fresh MTP (Costar 9017) and absorbance was measured at 405 nm using a SpectraMax plate reader. Absorbance results were obtained by subtracting the value for a blank control (no enzyme) from each sample value (hereinafter "blank subtracted absorbance"). For each condition, a ratio is determined by dividing the blank subtracted absorbance of each enzyme, including the Parent, by the predicted absorbance value of the Parent at the same concentration. This value is determined from a standard curve of purified Parent that was fitted to a Langmuir fit. PI was calculated by dividing the above calculated ratio for each enzyme by the above ratio calculated for the Parent.

TABLE 1

ADW Detergent Composition*

Solid Composition

| Ingredient | Composition A Wt % | Composition C Wt % |
|---|---|---|
| Sodium carbonate, granular | 41.17 | 41.17 |
| Sodium silicate | 0.88 | 0.88 |
| Carboxylated/sulfonated polymer | 7.19 | 7.19 |
| Surfactant - Plurafac ® SLF180 | 0.58 | 0.58 |
| Water | 0.81 | 0.81 |
| Sodium sulphate | 13.64 | 13.64 |
| Methylglycine diacetic acid | 23.34 | 23.34 |
| Bleach activator | 0.29 | 0.29 |
| Sodium percarbonate | 6.01 | 6.01 |
| Perfume and Processing Aids | Balance | — |
| Perfume, amylase, and Processing Aids | — | Balance |

Liquid composition (Composition B)

| Ingredient | Weight % |
|---|---|
| Dipropylene glycol | 20.67 |
| Surfactant - Plurafac ® SLF180 | 59.05 |
| Lutensol TO7 | 14.39 |
| Glycerine | 1.0 |
| Dye | 4.0 |
| Processing Aids | Balance |

*Does not contain any protease

Thermostability in ADW Detergent

To measure enzyme stability, Composition A, as dissolved in deionized water to a final concentration of 3.95 g/L at the desired water hardness (either 1 or 19 gpg), and aliquots of GG36 variant were added to reach the desired enzyme concentration. The proteolytic activity of the proteases was subsequently measured before and after a heat incubation step using the DMC protease activity assay described above. The temperature and duration of the heat incubation step were chosen such that the reference protease showed ~30% residual activity. The measurements were conducted in: (a) soft water (1 gpg) at stress temperatures ranging from 48° C. to 57° C., and (b) hard water (19 gpg) at stress temperatures ranging from 56° C. to 71° C. % residual activities were calculated by taking a ratio of the stressed to unstressed activity and multiplying by 100. Stability PIs were obtained by dividing the residual activity of the GG36 variant by that of the Parent. As the stability of the variants increased, the Parent was unable to be used as the control for measuring % residual activity due to the large differences in stability between the Parent and the increasingly more stable variants. JV0009, which could be stressed to a similar % residual activity as the other variants, was chosen as the new control variant and subsequently used in place of the Parent to calculate PIs for these variants. To convert the PIs calculated with respect to JV0009 to the Parent, the half-lives of JV0009 and Parent were determined at 1 and 19 gpg. The half-lives were determined by measuring the remaining DMC activity at different time points and then fitting the times points versus the remaining activity to the single exponential decay function. The ratio of calculated half-lives at each water hardness was used to convert the PIs calculated with respect to JV0009 to PIs with respect to Parent. The PIs set forth in Table 4 were converted in this manner from JV0009 to Parent.

Cleaning Performance in Laundry Detergent

Cleaning performance of GG36 variants was tested relative to JV0001 using EMPA-116 microswatches (blood/milk/ink on cotton, purchased from Center for Testmaterials BV, Vlaardingen, Netherlands) as a read out for laundry based applications. The assays were performed using commercially available heavy duty liquid laundry (HDL) detergent TIDE® (Original scent, Procter and Gamble), purchased from local supermarkets in 2016.

To abolish background enzyme activity, the enzymes present in this commercial detergent were inactivated by incubating the detergent at 95° C. for 4 hours in a water bath. Following the heat incubation, the detergent was assayed for any remaining background protease activity using the AAPF activity assay described above—protease activity was not detected after the 4-hour heat incubation, demonstrating inactivation of background activity.

Pre-punched (to fit on MTP) swatches in MTP plates (non-binding flat-bottom clear polystyrene 96-well plates, Corning 3641) were prepared by Center for Testmaterials BV, Vlaardingen, Netherlands. These microswatch-containing plates were pre-rinsed by adding 180 µL of de-ionized water to each swatch-containing well and shaking the plates at 25° C. for 15 minutes at 1150 rpm (e.g. in an iEMS incubator/shaker, Thermo Fisher Scientific, Waltham, MA). The rinse water was removed and the swatches were then air dried in the plate overnight.

For this assay, the protein concentration in enzyme supernatants was determined by Bradford method using Bio-Rad Protein Assay Dye Reagent Concentrate (Catalog Number 500-0006, Bio-Rad Laboratories, Hercules, CA), according to manufacturer's instructions. Briefly, the reagent concentrate was diluted with deionized water to working concentration (4:1 (v/v) ratio of water to concentrate) and aliquots of diluted enzyme supernatants were mixed with the working reagent (1:20 (v/v) ratio of sample to reagent) in each well of a microtiter plate (e.g. non-binding, flat bottom clear polystyrene plate, Corning 3641). The plate was incubated for 10 minutes at room temperature and absorbance at 595 nm was measured in a plate reader spectrophotometer (e.g. SpectraMax Plus 384, Molecular Devices, Sunnyvale, CA). The protein concentration in the samples was determined based on the standard curve of purified JV0001 protease.

To test the cleaning performance of enzyme variants, aliquots of enzyme supernatants were added to microswatch-containing MTPs prefilled with the solution of heat-inactivated TIDE® detergent (final detergent concentration 0.78 g/L, diluted using 5 mM HEPES buffer, pH 8.2 and 6 gpg water hardness) to reach a final volume of 180 uL per well, with a final enzyme concentration between 0.5-2.5 ppm. The MTPs were sealed and then incubated in an iEMS incubator/shaker (Thermo Fisher Scientific, Waltham, MA) at 25° C. with agitation at 1150 rpm for 30 min. Following the incubation, 100 µL of wash liquor supernatant were transferred to a fresh MTP (e.g. medium binding, flat bottom clear polystyrene plate, Corning 9017) and absorbance was measured at 600 nm in a plate reader spectrophotometer (e.g. SpectraMax Plus 384, Molecular Devices, Sunnyvale, CA). The absorbance value of a blank control (no enzyme) was subtracted from the absorbance value of each sample to obtain blank subtracted absorbance results (hereinafter "blank subtracted absorbance"). For each condition, a ratio is determined by dividing the blank subtracted absorbance of each enzyme, including the JV0001 protease by the predicted absorbance value of the JV0001 protease at the same concentration. This predicted absorbance value is determined from a standard curve of purified JV0001 protease that was fitted to a Langmuir fit. Performance Index (PI) was computed by dividing the above calculated ratio for each enzyme by the above ratio calculated for the JV0001 protease.

Thermostability in Laundry Detergent

Protease stability of GG36 variants was evaluated by measuring residual activity of samples after incubation under stress conditions using commercially available heavy duty liquid laundry (HDL) detergent TIDE® (Original scent, Procter and Gamble), purchased from local supermarkets in 2016. To abolish background enzyme activity, the enzymes present in this commercial detergent were inactivated using the protocol described above under "Cleaning Performance in Laundry Detergent" (incubating the detergent at 95° C. for 4 hours in a water bath and demonstrating the absence of background protease activity using the AAPF activity assay).

Heat-inactivated detergent was diluted to 10% w/w in deionized water and aliquots of GG36 variants were added to reach the desired enzyme concentration. The proteolytic activity of the proteases was subsequently measured before and after a heat incubation step, using the AAPF protease activity assay described above. GG36, JV0001, and JV0009 were used as controls and incubation conditions were chosen such that one of the controls displayed 30-60% residual activity. The heat incubation step was conducted for 5 minutes at stress temperatures ranging from 50° C. to 61° C.

The protease-detergent samples were diluted 10-fold in dilution solution (10 mM sodium chloride, 0.1 mM calcium chloride, 0.005% Tween 80, and 0.02% sodium azide) before performing the AAPF activity assay. Unstressed and stressed activity values were determined in triplicate. Residual activities for each replicate were calculated by dividing blank-subtracted stressed activity by the blank-subtracted unstressed activity. These triplicate residual activity measurements were subsequently averaged and multiplied by 100 to express them as % residual activity.

EXAMPLE 2

Cloning and Expression of GG36 Protease Variants

DNA manipulations to generate GG36 variants were carried out using conventional molecular biology techniques (see, e.g., Sambrook et al, Molecular Cloning: Cold Spring Harbor Laboratory Press). An artificial DNA sequence was generated that introduced multiple amino acid modifications into the sequence of GG36 WT to generate the different variants. The nucleotide sequence of the GG36 WT gene is set forth as SEQ ID NO:3. DNA cassettes comprising the *B. subtilis* aprE promoter set forth as SEQ ID NO:4 and the *B. subtilis* aprE signal peptide set forth as SEQ ID NO:5 were synthesized. Using techniques known in the art, PCR fragments were assembled using Gibson Assembly to make the final expression cassettes. The amino acid sequence of the aprE signal peptide from *B. subtilis* encoded by SEQ ID NO:5 is set forth as SEQ ID NO:6.

The expression cassette incorporating the GG36 variants and other elements described above was either integrated into the chromosome of a suitable *B. subtilis* strain or cloned into the pSB replicating shuttle vector (Babé LM, Yoast S, Dreyer M, and Schmidt B F, "Heterologous expression of human granzyme K in Bacillus subtilis and characterization of its hydrolytic activity in vitro", Biotechnol Appl Biochem., 27, Pt 2, 117-24, 1998) and transformed into a suitable *B. subtilis* strain. The pSB vector was derived from pBNppt, which was constructed by cloning the aprE gene fragment into plasmid pBN3. Plasmid pBN3 was constructed by removing the PstI site in the ampicillin gene from plasmid pBN2. Plasmid pBN2 was a hybrid plasmid of pBR322 and pUB110 with a multiple cloning site from pUC18. DNA fragments comprising *B. subtilis* expression cassette (set forth as SEQ ID NO: 7) and GG36 gene (set forth as SEQ ID NO: 3) were amplified by PCR using primers listed on Table 2.

TABLE 2

Primers Used To Construct GG36 *B. Subtilis* Expression Cassette

| Primer | Sequence | SEQ ID NO: |
|---|---|---|
| ROS28 | AGAGGATGCAGAAGTAACGACAATGGCG | 8 |
| ROS29 | CCAAGGCCGGTTTTTTATGTAAGCTTA | 9 |
| ROS12 | CAGAAGCTGCAACTCGTTAATAAGCTTACATAAAAAACCGGCCTTGG | 10 |
| ROS32 | CGCCATTGTCGTTACTTCTGCATCCTCT | 11 |
| F14-01 | GATAGAGCTGGGTAAAGCCTATGAATTCTCCATTTTCTTCTGCTATC | 12 |
| F14-02 | ATAGGCTTTACCCAGCTCTATCACAAACGAAAATTGGATAAAGTG | 13 |

Using techniques known in the art, PCR fragments were assembled using Gibson Assembly (SGI DNA Cat #GA1100-10) to make the final expression cassette. The *B. subtilis* cells were transformed and grown on agar-solidified LB supplemented with 5 µg/ml chloramphenicol.

To generate GG36 variant samples for biochemical characterization, selective growth of the transformed *B. subtilis* cells was performed in 96 well MTPs at 32° C. for 96 hours in cultivation medium (enriched semi-defined media based on MOPS buffer, with urea as the major nitrogen source, glucose as the main carbon source, and supplemented with 1% soytone for robust cell growth) in each well. Cultures were harvested by centrifugation at 3600 rpm for 45 min and filtered through Multiscreen® filter plates (EMD Millipore, MA, USA) using a Millipore vacuum system. The filtered culture supernatants were used for the assays described below.

The GG36 protease variants that were generated are listed in Tables 3 and 4 with mutations described relative to GG36 using BPN' numbering.

TABLE 3

GG36 Protease Variants

| Sample ID | Sequence Substitutions Relative to GG36 Parent (BPN' Numbering) | SEQ ID NO: |
|---|---|---|
| JV0001 | N76D-S87R-G118R-S128L-P129Q-S130A | 14 |
| JV0003 | N18R-S24R-N76D-S87R-G118R-S128L-P129Q-S130A-H249R | 15 |
| JV0004 | N76D-S78N-S87R-G118R-S128L-P129Q-S130A | 16 |
| JV0006 | N18R-S24R-N76D-S78N-S87R-G118R-S128L-P129Q-S130A-H249R | 17 |
| JV0008 | N76D-S87R-G118R-S128L-P129Q-S130A-Q206L | 18 |
| JV0009 | N76D-S78N-S87R-G118R-S128L-P129Q-S130A-Q206L | 19 |
| JV0012 | N18R-S24R-N76D-S78N-S87R-G118R-S128L-P129Q-S130A-Q206L-H249R | 20 |
| JV0019 | N76D-S78N-S87R-G118R-S128L-P129Q-S130A-M222Q | 21 |

TABLE 3-continued

GG36 Protease Variants

| Sample ID | Sequence Substitutions Relative to GG36 Parent (BPN' Numbering) | SEQ ID NO: |
|---|---|---|
| JV0058 | S3V-N76D-S78N-S87R-G118R-S128L-P129Q-S130A-Q206L | 22 |
| JV0059 | N76D-S78N-S87R-S101V-G118R-S128L-P129Q-S130A-Q206L | 23 |
| JV0060 | N76D-S78N-S87R-G118R-G127T-S128L-P129Q-S130A-Q206L | 24 |
| JV0067 | N76D-S78N-S87R-G118R-S128L-P129Q-S130A-Q206L-S212D | 25 |
| JV0068 | N76D-S78N-S87R-G118R-S128L-P129Q-S130A-S166D-Q206L | 26 |
| JV0069 | S3V-N76D-S78N-S87R-S101G-S103A-V104I-G118R-S128L-P129Q-S130A-Q206L | 27 |
| JV0071 | N76D-S78N-S87R-G118R-S128L-P129Q-S130A-Q206L-T213A | 28 |
| JV0072 | N76D-S78N-S87R-G118R-S128L-P129Q-S130A-Q206L-A232V-Q245R | 29 |
| JV0073 | N76D-S78N-S87R-G118R-S128L-P129Q-S130A-G159D-S188D-Q206L-A232V-Q245R | 30 |
| JV0098 | S24R-N76D-S78N-S87R-G118R-S128L-P129Q-S130A-Q206L-H249R | 31 |
| JV0099 | N18R-S24R-N76D-S78N-S87R-G118R-S128L-P129Q-S130A-Q206L | 32 |
| JV0100 | S24R-N76D-S78N-S87R-G118R-S128L-P129Q-S130A-Q206L | 33 |
| JV0104 | N76D-S78N-S87R-G118R-S128L-P129Q-S130A-Y209W | 34 |
| JV0105 | N76D-S78N-S87R-G118R-S128L-P129Q-S130A-Q206L-Y209W | 35 |
| JV0113 | N76D-S78N-S87R-G118R-S128L-P129Q-S130A-Q206L-M222S | 36 |
| JV0114 | S3T-N76D-S78N-S87R-G118R-S128L-P129Q-S130A-Q206L | 37 |
| JV0117 | V28T-N76D-S78N-S87R-G118R-S128L-P129Q-S130A-Q206L | 38 |
| JV0118 | N76D-S78N-S87R-A108S-G118R-S128L-P129Q-S130A-Q206L | 39 |
| JV0119 | N76D-S78N-S87R-N116M-G118R-S128L-P129Q-S130A-Q206L | 40 |
| JV0120 | N76D-S78N-S87R-G118R-L124M-S128L-P129Q-S130A-Q206L | 41 |
| JV0121 | N76D-S78N-S87R-G118R-S128L-P129Q-S130A-V150T-Q206L | 42 |
| JV0122 | N76D-S78N-S87R-G118R-S128L-P129Q-S130A-A194D-Q206L | 43 |
| JV0123 | N76D-S78N-S87R-G118R-S128L-P129Q-S130A-A158E-Q206L | 44 |
| JV0125 | V28T-N76D-S78N-S87R-S101F-G118R-S128L-P129Q-S130A-A194D-Q206L | 46 |
| JV0126 | S24R-V28T-N43S-N76D-S78N-S87R-G118R-S128L-P129Q-S130A-A158E-Q206L | 47 |
| JV0127 | S24R-V28T-N76D-S78N-S87R-G118R-S128L-P129Q-S130A-A194D-Q206L | 48 |
| JV0131 | S24R-N76D-S78N-S87R-G118R-S128L-P129Q-S130A-Q206L-T213A | 49 |
| JV0133 | N76D-S78N-S87R-S103D-G118R-S128L-P129Q-S130A-Q206L | 50 |
| JV0134 | S24R-V28T-N76D-S78N-S87R-S101V-A108S-G118R-S128L-P129Q-S130A-Q206L-T213A-L217K | 51 |
| JV0135 | S24R-N76D-S78N-S87R-G118R-S128L-P129Q-S130A-Q206L-L217K | 52 |
| JV0148 | S3V-N76D-S78N-S87R-G118R-S128L-P129Q-S130A | 45 |
| JV0149 | S3V-N76D-S78N-S87R-G118R-S128L-P129Q-S130A-Y209W | 171 |
| JV0196 | N76D-S78G-S87R-G118R-S128L-P129Q-S130A-Q206F | 195 |
| JV0198 | N76D-S78G-S87R-G118R-S128L-P129Q-S130A-Q206Y | 196 |
| JV0199 | S3V-N76D-S78G-S87R-G118R-S128L-P129Q-S130A-Q206F | 197 |

TABLE 3-continued

GG36 Protease Variants

| Sample ID | Sequence Substitutions Relative to GG36 Parent (BPN' Numbering) | SEQ ID NO: |
|---|---|---|
| JV0200 | S3V-N76D-S78G-S87R-G118R-S128L-P129Q-S130A-Q206M | 198 |
| JV0201 | S3V-N76D-S78G-S87R-G118R-S128L-P129Q-S130A-Q206Y | 199 |
| JV0202 | N76D-S78N-S87R-G118R-S128L-P129Q-S130A-Q206F | 200 |
| JV0203 | N76D-S78N-S87R-G118R-S128L-P129Q-S130A-Q206M | 201 |
| JV0204 | N76D-S78N-S87R-G118R-S128L-P129Q-S130A-Q206Y | 202 |
| JV0205 | S3V-N76D-S78N-S87R-G118R-S128L-P129Q-S130A-Q206F | 203 |
| JV0206 | S3V-N76D-S78N-S87R-G118R-S128L-P129Q-S130A-Q206M | 204 |
| JV0207 | S3V-N76D-S78N-S87R-G118R-S128L-P129Q-S130A-Q206Y | 205 |
| JV0239 | P40E-N76D-S87R-G118R-S128L-P129Q-S130A | 206 |
| JV0240 | I8V-P40E-N76D-S87R-G118R-S128L-P129Q-S130A | 207 |
| JV0241 | P40E-N76D-S87R-G118R-S128L-P129Q-S130A-P210I | 208 |
| JV0242 | P40E-N76D-S87R-G118R-S128L-P129Q-S130A-G211P | 209 |
| JV0243 | P40E-N76D-S87R-G118R-S128L-P129Q-S130A-N261I | 210 |
| JV0253 | N76D-S78N-S87R-G118R-S128L-P129Q-S130A-P210I | 211 |
| JV0254 | N76D-S78N-S87R-G118R-S128L-P129Q-S130A-Y209W-L262Q | 212 |
| JV0255 | N76D-S78N-S87R-G118R-S128L-P129Q-S130A-P210I-L262Q | 213 |
| JV0260 | N76D-S78N-S87R-G118R-S128L-P129Q-S130A-V147I-A194P-A215V-E271D | 214 |
| JV0262 | T22W-N76D-S78N-S87R-G118R-S128L-P129Q-S130A-V147I-A194P-A215V | 215 |
| JV0263 | T22W-N76D-S78N-S87R-G118R-S128L-P129Q-S130A-V147I-A215V-E271D | 216 |
| JV0304 | N76D-S87R-G118R-S128L-P129Q-S130A-L217K | 217 |
| JV0309 | N76D-S78N-S87R-G118R-S128L-P129Q-S130A-L217K | 218 |
| JV0310 | N76D-S78N-S87R-G118R-S128L-P129Q-S130A-V150T | 219 |
| JV0354 | N76D-S78G-S87R-G118R-S128L-P129Q-S130A-P210L | 220 |
| JV0355 | N76D-S87R-E89H-G118R-S128L-P129Q-S130A-Q206Y | 221 |
| JV0356 | S3V-N76D-S87R-E89H-G118R-S128L-P129Q-S130A-P210L | 222 |
| GG36-09606 | N76D-S78N-S87R-S103P-G118R-S128L-P129Q-S130A-Q206L | 53 |
| GG36-09610 | N76D-S78N-S87R-G118R-S128L-P129Q-S130A-Q206L-N243S | 54 |
| GG36-09615 | N76D-S78N-S87R-G118R-S128L-P129Q-S130A-Q206L-H249R | 55 |
| GG36-09621 | N18R-N76D-S78N-S87R-G118R-S128L-P129Q-S130A-Q206L | 56 |
| GG36-09625 | N18R-N76D-S78N-S87R-G118R-S128L-P129Q-S130A-Q206L-H249R | 57 |
| GG36-09629 | N18R-S24R-N76D-S78N-S87R-G118R-S128L-P129Q-S130A-Q206L-H249N | 58 |
| GG36-09634 | N18R-S24R-N76D-S78N-S87R-S99N-G118R-S128L-P129Q-S130A-A158T-Q206L-I246V-H249R | 59 |
| GG36-09667 | N18R-S24R-N76D-S78N-S87R-G118R-S128L-P129Q-S130A-Q206L-K235T | 60 |
| GG36-09846 | N18R-S24R-N76D-S78N-S87R-G118R-S128L-P129Q-S130A-Q206L-A270T | 61 |

TABLE 3-continued

GG36 Protease Variants

| Sample ID | Sequence Substitutions Relative to GG36 Parent (BPN' Numbering) | SEQ ID NO: |
|---|---|---|
| GG36-13631 | N76D-S78Q-S87R-G118R-S128L-P129Q-S130A-Q206D | 223 |
| GG36-13641 | N76D-S78T-S87R-G118R-S128L-P129Q-S130A-Q206D | 224 |
| GG36-13643 | N76D-S78V-S87R-G118R-S128L-P129Q-S130A-Q206D | 225 |
| GG36-13647 | N76D-S78W-S87R-G118R-S128L-P129Q-S130A-Q206D | 226 |
| GG36-13652 | N76D-S78Y-S87R-G118R-S128L-P129Q-S130A-Q206D | 227 |
| GG36-13662 | N76D-S78A-S87R-G118R-S128L-P129Q-S130A-Q206F | 228 |
| GG36-13663 | N76D-S78C-S87R-G118R-S128L-P129Q-S130A-Q206F | 229 |
| GG36-13667 | N76D-S78E-S87R-G118R-S128L-P129Q-S130A-Q206F | 230 |
| GG36-13674 | N76D-S78F-S87R-G118R-S128L-P129Q-S130A-Q206F | 231 |
| GG36-13679 | N76D-S78H-S87R-G118R-S128L-P129Q-S130A-Q206F | 232 |
| GG36-13687 | N76D-S78K-S87R-G118R-S128L-P129Q-S130A-Q206F | 233 |
| GG36-13691 | N76D-S78L-S87R-G118R-S128L-P129Q-S130A-Q206F | 234 |
| GG36-13696 | N76D-S78M-S87R-G118R-S128L-P129Q-S130A-Q206F | 235 |
| GG36-13703 | N76D-S78Q-S87R-G118R-S128L-P129Q-S130A-Q206F | 236 |
| GG36-13711 | N76D-S78T-S87R-G118R-S128L-P129Q-S130A-Q206F | 237 |
| GG36-13719 | N76D-S78W-S87R-G118R-S128L-P129Q-S130A-Q206F | 238 |
| GG36-13724 | N76D-S78Y-S87R-G118R-S128L-P129Q-S130A-Q206F | 239 |
| GG36-13735 | N76D-S78C-S87R-G118R-S128L-P129Q-S130A-Q206G | 240 |
| GG36-13767 | N76D-S78M-S87R-G118R-S128L-P129Q-S130A-Q206G | 241 |
| GG36-13791 | N76D-S78C-S87R-G118R-S128L-P129Q-S130A-Q206H | 242 |
| GG36-13796 | N76D-S78E-S87R-G118R-S128L-P129Q-S130A-Q206H | 243 |
| GG36-13802 | N76D-S78F-S87R-G118R-S128L-P129Q-S130A-Q206H | 244 |
| GG36-13803 | N76D-S78G-S87R-G118R-S128L-P129Q-S130A-Q206H | 245 |
| GG36-13807 | N76D-S78H-S87R-G118R-S128L-P129Q-S130A-Q206H | 246 |
| GG36-13819 | N76D-S78L-S87R-G118R-S128L-P129Q-S130A-Q206H | 247 |
| GG36-13831 | N76D-S78T-S87R-G118R-S128L-P129Q-S130A-Q206H | 248 |
| GG36-13839 | N76D-S78V-S87R-G118R-S128L-P129Q-S130A-Q206H | 249 |
| GG36-13851 | N76D-S78A-S87R-G118R-S128L-P129Q-S130A-Q206M | 250 |
| GG36-13855 | N76D-S78C-S87R-G118R-S128L-P129Q-S130A-Q206M | 251 |
| GG36-13859 | N76D-S78E-S87R-G118R-S128L-P129Q-S130A-Q206M | 252 |
| GG36-13864 | N76D-S78F-S87R-G118R-S128L-P129Q-S130A-Q206M | 253 |
| GG36-13867 | N76D-S78G-S87R-G118R-S128L-P129Q-S130A-Q206M | 254 |
| GG36-13872 | N76D-S78I-S87R-G118R-S128L-P129Q-S130A-Q206M | 255 |
| GG36-13875 | N76D-S78K-S87R-G118R-S128L-P129Q-S130A-Q206M | 256 |
| GG36-13879 | N76D-S78L-S87R-G118R-S128L-P129Q-S130A-Q206M | 257 |
| GG36-13886 | N76D-S78M-S87R-G118R-S128L-P129Q-S130A-Q206M | 258 |
| GG36-13893 | N76D-S78Q-S87R-G118R-S128L-P129Q-S130A-Q206M | 259 |

TABLE 3-continued

GG36 Protease Variants

| Sample ID | Sequence Substitutions Relative to GG36 Parent (BPN' Numbering) | SEQ ID NO: |
|---|---|---|
| GG36-13895 | N76D-S78R-S87R-G118R-S128L-P129Q-S130A-Q206M | 260 |
| GG36-13899 | N76D-S78T-S87R-G118R-S128L-P129Q-S130A-Q206M | 261 |
| GG36-13903 | N76D-S78V-S87R-G118R-S128L-P129Q-S130A-Q206M | 262 |
| GG36-13911 | N76D-S78Y-S87R-G118R-S128L-P129Q-S130A-Q206M | 263 |
| GG36-13919 | N76D-S78A-S87R-G118R-S128L-P129Q-S130A-Q206N | 264 |
| GG36-13924 | N76D-S78C-S87R-G118R-S128L-P129Q-S130A-Q206N | 265 |
| GG36-13928 | N76D-S78E-S87R-G118R-S128L-P129Q-S130A-Q206N | 266 |
| GG36-13935 | N76D-S78G-S87R-G118R-S128L-P129Q-S130A-Q206N | 267 |
| GG36-13939 | N76D-S78H-S87R-G118R-S128L-P129Q-S130A-Q206N | 268 |
| GG36-13943 | N76D-S78I-S87R-G118R-S128L-P129Q-S130A-Q206N | 269 |
| GG36-13953 | N76D-S78L-S87R-G118R-S128L-P129Q-S130A-Q206N | 270 |
| GG36-13958 | N76D-S78M-S87R-G118R-S128L-P129Q-S130A-Q206N | 271 |
| GG36-13963 | N76D-S78Q-S87R-G118R-S128L-P129Q-S130A-Q206N | 272 |
| GG36-14040 | N76D-S78R-S87R-G118R-S128L-P129Q-S130A-Q206P | 273 |
| GG36-14051 | N76D-S78W-S87R-G118R-S128L-P129Q-S130A-Q206P | 274 |
| GG36-14064 | N76D-S78A-S87R-G118R-S128L-P129Q-S130A-Q206R | 275 |
| GG36-14069 | N76D-S78C-S87R-G118R-S128L-P129Q-S130A-Q206R | 276 |
| GG36-14072 | N76D-S78E-S87R-G118R-S128L-P129Q-S130A-Q206R | 277 |
| GG36-14075 | N76D-S78F-S87R-G118R-S128L-P129Q-S130A-Q206R | 278 |
| GG36-14079 | N76D-S78G-S87R-G118R-S128L-P129Q-S130A-Q206R | 279 |
| GG36-14083 | N76D-S78H-S87R-G118R-S128L-P129Q-S130A-Q206R | 280 |
| GG36-14088 | N76D-S78I-S87R-G118R-S128L-P129Q-S130A-Q206R | 281 |
| GG36-14095 | N76D-S78L-S87R-G118R-S128L-P129Q-S130A-Q206R | 282 |
| GG36-14099 | N76D-S78M-S87R-G118R-S128L-P129Q-S130A-Q206R | 283 |
| GG36-14103 | N76D-S78P-S87R-G118R-S128L-P129Q-S130A-Q206R | 284 |
| GG36-14107 | N76D-S78Q-S87R-G118R-S128L-P129Q-S130A-Q206R | 285 |
| GG36-14111 | N76D-S78R-S87R-G118R-S128L-P129Q-S130A-Q206R | 286 |
| GG36-14115 | N76D-S78T-S87R-G118R-S128L-P129Q-S130A-Q206R | 287 |
| GG36-14120 | N76D-S78V-S87R-G118R-S128L-P129Q-S130A-Q206R | 288 |
| GG36-14139 | N76D-S78C-S87R-G118R-S128L-P129Q-S130A-Q206S | 289 |
| GG36-14144 | N76D-S78E-S87R-G118R-S128L-P129Q-S130A-Q206S | 290 |
| GG36-14149 | N76D-S78H-S87R-G118R-S128L-P129Q-S130A-Q206S | 291 |
| GG36-14155 | N76D-S78M-S87R-G118R-S128L-P129Q-S130A-Q206S | 292 |
| GG36-14176 | N76D-S78W-S87R-G118R-S128L-P129Q-S130A-Q206S | 293 |
| GG36-14187 | N76D-S78C-S87R-G118R-S128L-P129Q-S130A-Q206Y | 294 |
| GG36-14192 | N76D-S78E-S87R-G118R-S128L-P129Q-S130A-Q206Y | 295 |
| GG36-14204 | N76D-S78H-S87R-G118R-S128L-P129Q-S130A-Q206Y | 296 |
| GG36-14207 | N76D-S78I-S87R-G118R-S128L-P129Q-S130A-Q206Y | 297 |

TABLE 3-continued

GG36 Protease Variants

| Sample ID | Sequence Substitutions Relative to GG36 Parent (BPN' Numbering) | SEQ ID NO: |
|---|---|---|
| GG36-14211 | N76D-S78K-S87R-G118R-S128L-P129Q-S130A-Q206Y | 298 |
| GG36-14215 | N76D-S78L-S87R-G118R-S128L-P129Q-S130A-Q206Y | 299 |
| GG36-14219 | N76D-S78M-S87R-G118R-S128L-P129Q-S130A-Q206Y | 300 |
| GG36-14227 | N76D-S78Q-S87R-G118R-S128L-P129Q-S130A-Q206Y | 301 |
| GG36-14232 | N76D-S78R-S87R-G118R-S128L-P129Q-S130A-Q206Y | 302 |
| GG36-14236 | N76D-S78T-S87R-G118R-S128L-P129Q-S130A-Q206Y | 303 |
| GG36-14246 | N76D-S78W-S87R-G118R-S128L-P129Q-S130A-Q206Y | 304 |
| GG36-14248 | N76D-S78Y-S87R-G118R-S128L-P129Q-S130A-Q206Y | 305 |
| GG36-14271 | N76D-S78H-S87R-G118R-S128L-P129Q-S130A-Q206A | 306 |
| GG36-14295 | N76D-S78H-S87R-G118R-S128L-P129Q-S130A-Q206D | 307 |
| GG36-14301 | N76D-S78I-S87R-G118R-S128L-P129Q-S130A-Q206D | 308 |
| GG36-14307 | N76D-S78L-S87R-G118R-S128L-P129Q-S130A-Q206D | 309 |
| GG36-14311 | N76D-S78P-S87R-G118R-S128L-P129Q-S130A-Q206D | 310 |
| GG36-14401 | N76D-S78C-S87R-G118R-S128L-P129Q-S130A-Q206A | 311 |
| GG36-14427 | N76D-S78Q-S87R-G118R-S128L-P129Q-S130A-Q206A | 312 |
| GG36-14439 | N76D-S78A-S87R-G118R-S128L-P129Q-S130A-Q206D | 313 |
| GG36-14444 | N76D-S78C-S87R-G118R-S128L-P129Q-S130A-Q206D | 314 |
| GG36-14447 | N76D-S78E-S87R-G118R-S128L-P129Q-S130A-Q206D | 315 |
| GG36-14455 | N76D-S78G-S87R-G118R-S128L-P129Q-S130A-Q206D | 316 |
| GG36-14459 | N76D-S78M-S87R-G118R-S128L-P129Q-S130A-Q206D | 317 |
| GG36-14463 | N76D-S78M-S87R-G118R-S128L-P129Q-S130A-Q206H | 318 |
| GG36-14467 | N76D-S78A-S87R-G118R-S128L-P129Q-S130A-Q206H | 319 |
| GG36-14478 | N76D-S78H-S87R-G118R-S128L-P129Q-S130A-Q206M | 320 |

TABLE 4

Additional GG36 Protease Variants

| Sample ID | Sequence Substitutions Relative to GG36 Parent (BPN' Numbering) | SEQ ID NO: |
|---|---|---|
| JV0005 | N18R-S24R-N76D-S78N-H249R | 62 |
| JV0007 | N18R-S24R-N76D-S78N-S87R-H249R | 63 |
| JV0011 | N18R-S24R-N76D-S78N-Q206L-H249R | 64 |
| JV0014 | S24F-S78N-G118R-S166D | 193 |
| JV0017 | T22L-S24F-S78N-G118R-S166D-T213A | 194 |
| JV0024 | S24R-N76D-S87R-Q206Y-T213A-M222Q-H249R | 65 |
| JV0025 | S24R-N76D-S78N-S87D-G118R-Y209W-M222Q-H249R | 66 |
| JV0028 | S87D-Q206L-Y209W-T213A-H249R | 67 |
| JV0029 | S24R-N76D-S78N-S87R-G118R-Q206L-M222Q | 68 |
| JV0030 | S24R-N76D-S78N-Q206L-M222Q | 69 |

TABLE 4-continued

Additional GG36 Protease Variants

| Sample ID | Sequence Substitutions Relative to GG36 Parent (BPN' Numbering) | SEQ ID NO: |
|---|---|---|
| JV0031 | N76D-S78N-S87R-G118R-S128L-P129Q-Q206L-M222Q | 70 |
| JV0034 | N76D-S78N-S87R-G118R-P129Q-Q206L-M222Q | 71 |
| JV0035 | N76D-S78N-S87R-G118R-S130A-Q206L-M222Q | 72 |
| JV0036 | N76D-S78N-S87R-G118R-S128L-P129Q-Q206L | 73 |
| JV0037 | N76D-S78N-S87R-G118R-S128L-S130A-Q206L | 74 |
| JV0038 | N76D-S78N-S87R-G118R-S128L-Q206L | 75 |
| JV0039 | N76D-S78N-S87R-G118R-P129Q-Q206L | 76 |
| JV0040 | N76D-S78N-S87R-G118R-S130A-Q206L | 77 |
| JV0041 | N76D-S78N-S87R-G118R-Q206L-M222Q | 78 |
| JV0042 | N76D-S78N-S87R-G118R-Q206L | 79 |
| JV0043 | S24R-N76D-S78N-S87R-G118R-Y209W-M222Q | 80 |
| JV0044 | S24R-N43R-N76D-S78N-S87R-G118R-Y209W-M222Q | 81 |
| JV0045 | G20R-S24R-N43R-N76D-S78N-S87R-G118R-Y209W-M222Q | 82 |
| JV0046 | G20R-N43R-N76D-S78N-S87R-G118R-Y209W-M222Q | 83 |
| JV0047 | S24R-N76D-S78N-S87R-G118R-Q206L-Y209W-T213A-M222Q | 84 |
| JV0048 | S24R-N76D-S78N-S87R-G118R-Q206L-T213A-M222Q | 85 |
| JV0049 | S24R-N76D-S78N-S87R-G118R-Y209W-T213A-M222Q | 86 |
| JV0050 | S24R-N76D-S78N-S87R-N116L-G118R-Y209W-M222Q | 87 |
| JV0052 | G20R-S24R-N43R-N76D-S78N-S87R-N116L-G118R-Y209W-M222Q | 88 |
| JV0053 | N18R-N76D-S87R-S128L-P129Q-S130A-Q206L-Y209W-H249R | 89 |
| JV0054 | N18R-S87D-S166N-Q206L-Y209W | 90 |
| JV0055 | N18R-S24R-N76D-S78N-S87R-G118R-G127T-Y209W-T213A | 91 |
| JV0056 | N18R-S24R-S166D-Q206Y-H249R | 92 |
| JV0057 | S24R-S78N-S87R-S166D-Q206L-Y209W-H249R | 93 |
| JV0062 | N76D-S78N-S87R-S101G-S103A-V104I-G118R-Q206L | 94 |
| JV0063 | N76D-S78N-S87R-G118R-G127T-Q206L | 95 |
| JV0064 | N76D-S78N-S87R-G118R-G127T-P129Q-Q206L | 96 |
| JV0065 | N76D-S78N-S87R-G118R-G127T-P129Q-S130A-Q206L | 97 |
| JV0066 | N76D-S78N-S87R-S101G-S103A-V104I-G118R-G127T-P129R-Q206L | 98 |
| JV0074 | S3V-S24R-N76D-S78N-S87D-G118R-Y209W-M222Q-H249R | 99 |
| JV0075 | S24R-N76D-S78N-S87D-S101V-G118R-Y209W-M222Q-H249R | 100 |
| JV0078 | S24R-N76D-S78N-S87D-S101G-S103A-V104I-G118R-Y209W-M222Q-H249R | 101 |
| JV0079 | S24R-N76D-S78N-S87D-G118R-Y209W-S212D-M222Q-H249R | 102 |
| JV0081 | S3V-S24R-N76D-S78N-S87D-S101G-S103A-V104I-G118R-Y209W-M222Q-H249R | 103 |
| JV0085 | S24R-N76D-S78N-S87D-S101G-S103A-V104I-G118R-G127T-Y209W-T213A-M222Q-H249R | 104 |

TABLE 4-continued

Additional GG36 Protease Variants

| Sample ID | Sequence Substitutions Relative to GG36 Parent (BPN' Numbering) | SEQ ID NO: |
|---|---|---|
| JV0086 | S24R-N76D-S78N-S87D-S101G-S103A-V104I-G118R-Y209W-M222Q-A232V-Q245R-H249R | 105 |
| JV0088 | S24R-N76D-S78N-S87D-S101G-S103A-V104I-G118R-Y209W-H249R | 106 |
| JV0089 | S3V-S24R-N76D-S78N-S87D-S101G-S103A-V104I-G118R-Y209W-H249R | 107 |
| JV0090 | S24R-N76D-S78N-S87D-S101G-S103A-V104I-G118R-G127T-Y209W-T213A-H249R | 108 |
| JV0095 | S24R-N76D-S78N-S87D-S101T-G118R-Y209W-M222Q-H249R | 109 |
| JV0096 | S24R-N76D-S78N-S87D-S101H-G118R-Y209W-M222Q-H249R | 110 |
| JV0097 | S24R-N76D-S78N-S87D-G118R-P129Q-Y209W-M222Q-H249R | 111 |
| JV0101 | N76D-S78N-S87D-G118R-S128L-P129Q-S130A-Q206L | 112 |
| JV0102 | S24R-N76D-S78N-S87D-G118R-Y209W-H249R | 113 |
| JV0103 | S24R-N76D-S78N-S87R-G118R-Y209W-M222Q-H249R | 114 |
| JV0106 | N76D-S87R-S128L-P129Q-S130A-Q206L-Y209W-H249R | 115 |
| JV0108 | N76D-S87R-S128L-P129Q-S130A-Q206L-Y209W | 116 |
| JV0109 | S24R-N76D-S78N-S87D-G118R-Y209W-M222S-H249R | 117 |
| JV0110 | N76D-S78N-S87D-G118R-Y209W-H249R | 118 |
| JV0111 | N76D-S78N-S87D-G118R-Y209W-M222S-H249R | 119 |
| JV0112 | S24R-N76D-S78N-S87D-G118R-M222Q-H249R | 120 |
| JV0128 | S24R-N76D-S78N-S87D-G118R-S128L-P129Q-S130A-Q206L-T213A | 121 |
| JV0129 | S24R-V28T-N76D-S78N-S87D-S101V-A108S-G118R-S128L-P129Q-S130A-Q206L | 122 |
| JV0130 | S24R-V28T-N76D-S78N-S87D-S101V-N116M-G118R-S128L-P129Q-S130A-A158E-Q206L | 123 |
| JV0136 | S3V-S24R-N76D-S78N-S87R-G100S-S101V-G118R-Q206L-L217K | 124 |
| JV0137 | N76D-N77D-S78N-S87R-G118R-Q206L-T213A | 125 |
| JV0138 | S24R-N76D-S78N-S87D-G100S-S101V-N116M-G118R-L124M-S128L-P129Q-S130A-A194D-Q206L | 126 |
| JV0139 | S24R-V28T-N76D-S78N-S87R-G118V-S128L-P129Q-S130A-Q206L-T213A-L217K | 127 |
| JV0150 | S3V-S24R-N76D-S78N-S87D-G118R-Y209W-H249R | 321 |
| JV0152 | S3V-N76D-S78N-S87D-G118R-Y209W-H249R | 323 |
| JV0189 | S3I-N43Y-L82D-G127S-S216Y-L217K-S256P | 324 |
| JV0193 | G127S-S216Y | 325 |
| JV0208 | S3V-I8V-P40E-N76D-S87D-G118R-S128R-A215K-N261I | 326 |
| JV0209 | S3V-I8V-P40E-N76D-G118R-S128R-P210I-N261I | 327 |
| JV0210 | S3V-P40E-N76D-S87D-G118R-S128R-P210I-L217K | 328 |
| JV0211 | S3V-N76D-G118R-S128R | 329 |
| JV0212 | S3V-N76D-S87D-G118R-S128R | 330 |
| JV0213 | S3V-N76D-G118R-S128R-P210I | 331 |
| JV0214 | S3V-N76D-G118R-S128R-N261I | 332 |

TABLE 4-continued

Additional GG36 Protease Variants

| Sample ID | Sequence Substitutions Relative to GG36 Parent (BPN' Numbering) | SEQ ID NO: |
|---|---|---|
| JV0215 | S3V-P40E-N76D-G118R | 333 |
| JV0216 | S3V-P40E-N76D-G118R-S128R | 334 |
| JV0217 | S3V-I8V-P40E-N76D-G118R-S128R | 335 |
| JV0218 | S3V-P40E-N76D-S87D-G118R-S128R | 336 |
| JV0219 | S3V-P40E-N76D-G118R-S128R-S160Q | 337 |
| JV0221 | S3V-P40E-N76D-G118R-S128R-P210I | 338 |
| JV0222 | S3V-P40E-N76D-G118R-S128R-G211P | 339 |
| JV0223 | S3V-P40E-N76D-G118R-S128R-A215K | 340 |
| JV0224 | S3V-P40E-N76D-G118R-S128R-L217K | 341 |
| JV0225 | S3V-P40E-N76D-G118R-S128R-N261I | 342 |
| JV0226 | S3V-P40E-N76D-G118R-S128R-L262Q | 343 |
| JV0227 | S3V-I8V-P40E-N76D-G118R | 344 |
| JV0228 | S3V-P40E-N76D-S87D-G118R | 345 |
| JV0229 | S3V-P40E-N76D-G118R-S160Q | 346 |
| JV0230 | S3V-P40E-N76D-G118R-Q206Y | 347 |
| JV0231 | S3V-P40E-N76D-G118R-P210I | 348 |
| JV0232 | S3V-P40E-N76D-G118R-G211P | 349 |
| JV0233 | S3V-P40E-N76D-G118R-A215K | 350 |
| JV0234 | S3V-P40E-N76D-G118R-L217K | 351 |
| JV0235 | S3V-P40E-N76D-G118R-N261I | 352 |
| JV0236 | S3V-P40E-N76D-G118R-L262Q | 353 |
| JV0237 | S3V-N76D-G118R-S128R-G211P | 354 |
| JV0238 | S3V-N76D-G118R-S128R-L262Q | 355 |
| JV0257 | T22W-N76D-S78N-S87R-G118R-S128R-P129Q-S130A-V147I-A194P-A215V-E271D | 356 |
| JV0258 | N76D-S78N-S87R-G118R-S128R-P129Q-S130A | 357 |
| JV0261 | N76D-S78N-S87R-G118R-S128R-P129Q-S130A-V147I-A194P-A215V | 358 |
| JV0264 | N76D-S78N-S87R-G118R-S128R-P129Q-S130A-V147I-A194P-E271D | 359 |
| JV0265 | T22W-N76D-S78N-S87R-G118R-S128R-P129Q-S130A-A215V-E271D | 360 |
| JV0266 | T22W-N76D-S78N-S87R-G118R-S128R-P129Q-S130A-A194P-E271D | 361 |
| JV0276 | P40E-N76D-S78G-G118R-S128R-Q206Y-L262Q | 362 |
| JV0277 | S3V-P40E-N76D-G118R-G211P-L217K-N261I | 363 |
| JV0278 | I8V-P40E-N76D-S78G-G118R-Q206Y-L217K | 364 |
| JV0280 | S3V-I8V-N76D-S78G-S87D-G118R-P210I-A215K-N252I | 365 |
| JV0281 | S3V-P40E-N76D-G118R-S160Q-P210I-L217K-N261I | 366 |
| JV0282 | I8V-N76D-S78G-G118R-S160Q-Q206Y-N252I-N261I | 367 |
| JV0283 | I8V-P40E-N76D-G118R-P210I-A215K-N261I | 368 |
| JV0285 | I8V-P40E-N76D-S78G-G118R-Q206Y-P210I-A215K-N261I | 369 |

TABLE 4-continued

Additional GG36 Protease Variants

| Sample ID | Sequence Substitutions Relative to GG36 Parent (BPN' Numbering) | SEQ ID NO: |
|---|---|---|
| JV0286 | S3V-N76D-G118R-S160Q-G211P-A215V-L262Q | 370 |
| JV0287 | S3V-N76D-S87D-G118R-S128R-P210I-G211P-N261I-L262Q | 371 |
| JV0288 | S3V-P40E-N76D-G118R-Q206Y-P210I-G211P-A215K-N261I | 372 |
| JV0289 | I8V-P40E-N76D-S78G-G118R-G211P-L217K-N252I-N261I | 373 |
| JV0290 | S3V-P40E-N76D-S87D-G118R-S128R-P210I-L217K-N261I | 374 |
| JV0291 | S3V-P40E-N76D-G118R-S160Q-P210I-W241K-L262Q | 375 |
| JV0292 | I8V-N76D-S78G-G118R-P210I-A215V-N261I | 376 |
| JV0293 | N76D-S78G-S87D-G118R-P210I-A215V-L217K-N261I-L262Q | 377 |
| JV0294 | S3V-P40E-N76D-S78G-G118R-Q206Y-L217K | 378 |
| JV0297 | S3V-P40E-N76D-S78G-G118R-S128L-P129Q-S130A-L217K | 379 |
| JV0299 | S3V-P40E-N76D-S78G-G118R-S128L-P129Q-S130A-Q206Y-P210I-A215V-L217K | 380 |
| JV0301 | N76D-S78N-S87D-G118R-S128L-P129Q-S130A-Q206Y | 381 |
| JV0302 | S3V-P40E-N76D-S78G-G118R-S128L-P129Q-S130A-A215K-N261I | 382 |
| JV0303 | S3V-N76D-S87D-G118R-S128L-P129Q-S130A-P210I-L217K | 383 |
| JV0307 | N76D-S87R-G118R-S128K-V150T-L217K | 384 |
| JV0312 | N76D-S78N-S87R-G118R-S128K-V150T-L217K | 385 |
| JV0313 | N76D-S78N-S87R-G118R-S128K-V150T | 386 |
| JV0336 | S3V-N76D-S78G-S87D-G118A-S166N-A194P-Q206M-P210I-N218S-N248D-N261I-L262Q | 387 |
| JV0339 | S3V-N76D-S78G-S87T-S101Q-G118A-S130Q-S166N-A194P-P210I-N218S-N248D-S256P-N261I | 388 |
| JV0348 | S3V-N76D-S78G-S87D-S101Q-G118A-Q206M-P210I-L217K-N218S-M222Q-N248D-S256P | 389 |
| JV0357 | S24L-N76D-S78N-S87D-A88S-G118R-Q206Y-Y209W-H249R | 322 |
| GG36-08640 | N18R-S87R-G118R-S166N-N204D-Q206L-Y209W | 128 |
| GG36-08712 | N18R-S24R-L42I-G118R-Y209W-T213A-M222Q-H249R | 129 |
| GG36-08714 | N18R-S24R-Y209W-T213A-H249R | 130 |
| GG36-08717 | N18R-S24R-S87R-G118R-S128L-P129Q-S130A-Q206Y-Y209W-T213A-H249R | 131 |
| GG36-08725 | S24R-S87D-G118R-Y209W-T213A-H249R | 132 |
| GG36-08729 | S9G-N18R-S24R-N76D-G118R-S166N-Q206L-H249R | 133 |
| GG36-08734 | N18R-G118R-Q206L-Y209W-T213A-M222Q-H249R | 134 |
| GG36-08740 | S24R-S87R-S166N | 135 |
| GG36-08748 | N18R-S24R-S87R-Q206L-Y209W-T213A | 136 |
| GG36-08751 | N18R-S24R-G118R-A158V-Y209W | 137 |
| GG36-08772 | N18R-S24R-S87D-Q206L-Y209W-M222Q-H249R | 138 |
| GG36-08778 | N18R-S24R-S87R-G127T | 139 |
| GG36-08839 | S24R-S166N-Y209W-T213A | 140 |
| GG36-08866 | N76D-S78N-G118R-Y209W-H249R | 141 |

TABLE 4-continued

Additional GG36 Protease Variants

| Sample ID | Sequence Substitutions Relative to GG36 Parent (BPN' Numbering) | SEQ ID NO: |
|---|---|---|
| GG36-0888 | 4N18R-N76D-S78N-S87R-Q206L-Y209W-H249R-S259G | 142 |
| GG36-0889 | 4N18R-S24R-S87D-N185Y-Q206L-Y209W-T213A-M222Q-H249R | 143 |
| GG36-0890 | 2S24R-G118R-G127T-Y209W | 144 |
| GG36-0890 | 3A1V-N18R-S24R-S56P-G127T-Q206L-Y209W | 145 |
| GG36-0890 | 4S87R-Y209W | 146 |
| GG36-0894 | 0N18R-S87D-Y209W-M222Q-H249R | 147 |
| GG36-0894 | 1N18R-S24R-G118R-S128L-P129Q-S130A-S166D-Y209W-T213A | 148 |
| GG36-0915 | 4S87D-S166D-T213A-H249R | 149 |
| GG36-0917 | 5N18R-S24P-S87D-S166N-Q206L-Y209W-M222Q-H249R | 150 |
| GG36-0918 | 9N76D-S166N-Y209W-T213A-H249R | 151 |
| GG36-0920 | 1S24R-Q206L-Y209W-T213A-M222Q-H249R | 152 |
| GG36-0921 | 3N18R-G118R-Q206L-Y209W | 153 |
| GG36-0923 | 7N18R-S24R-S166D-Q206Y-H249R-A254T | 154 |
| GG36-0924 | 2N18R-S24R-S78N-Q206L-Y209W-T213A-M222Q-H249R | 155 |
| GG36-0927 | 8N18R-S24R-G118R-G127T-Y209W | 156 |
| GG36-0933 | 3S24R-N76D-G118R-S166N-Q206L-Y209W | 157 |
| GG36-0933 | 9S24R-N76D-S87R-Y209W-T213A-M222Q-H249R | 158 |
| GG36-0934 | 1N18K-S87R-Y209W-T213A-M222Q-H249R | 159 |
| GG36-0941 | 2N18R-S24R-S87R-Y209W | 160 |
| GG36-0941 | 3N18R-S78N-G118R-Y209W-T213A-M222Q-H249R-A270P | 161 |
| GG36-0942 | 6N18R-S166N-Y209W-T213A-M222Q | 162 |
| GG36-0964 | 2S24R-N76D-S78N-S128L-P129Q-S130A-Q206L-H249R | 163 |
| GG36-0964 | 5N18R-S24R-N76D-S78N-S128L-P129Q-S130A-Q206L-H249R | 164 |
| GG36-0964 | 6N76D-S78N-G118R-Q206L-H249R | 165 |
| GG36-0964 | 9N18R-I44V-N76D-S78N-S87R-S128L-P129Q-S130A-Q206L-H249R | 166 |
| GG36-0965 | 3N18R-N76D-S78N-S87R-Q206L-H249R | 167 |
| GG36-0965 | 6N18R-S24R-N76D-S78N-S87R-S128L-P129Q-S130A-Q206L | 168 |
| GG36-0965 | 9N76D-S78N-G118R-Q206L | 169 |
| GG36-0966 | 2A16T-N18R-S24R-N76D-S78N-G118R-S128L-P129Q-S130A-Q206L | 170 |
| GG36-0967 | 4S24R-N76D-S78N-Q206L-H249R | 172 |
| GG36-0967 | 6S24R-N76D-S78N-S87R-S128L-P129Q-S130A-Q206L | 173 |
| GG36-0984 | 2N18R-N76D-S78N-S87R-S128L-P129Q-S130A-Q206L | 174 |
| GG36-0984 | 4N18R-S24R-N76D-S78N-S128L-P129Q-S130A | 175 |
| GG36-0984 | 5S24R-N76D-S78N-H249R | 176 |
| GG36-0985 | 2N18R-S24R-N76D-S78N-G118R-S128L-P129Q-S130A-H249R | 177 |
| GG36-0985 | 7N18R-S24R-N76D-S78N-M222Q-H249R | 178 |
| GG36-0986 | 2N76D-S78N-S87R-Q206L-H249R | 179 |

TABLE 4-continued

Additional GG36 Protease Variants

| Sample ID | Sequence Substitutions Relative to GG36 Parent (BPN' Numbering) | SEQ ID NO: |
|---|---|---|
| GG36-09873 | N18R-N76D-S78N-Q206L-H249R | 180 |
| GG36-09875 | N18R-S24R-N76D-S78N-G118R-Q206L-K251R | 181 |
| GG36-09880 | N76D-S78N-Q206L-H249R | 182 |
| GG36-09882 | N18R-S24R-N76D-S78N-S87R-Q206L | 183 |
| GG36-09885 | N18R-S24R-N76D-S78N-G118R-S128L-P129Q-S130A | 184 |
| GG36-09886 | N76D-S78N-H120R-Q206L-H249R | 185 |
| GG36-09890 | N18R-N76D-S78N-S87R-S128L-P129Q-S130A-Q206L-H249R | 186 |
| GG36-09896 | N18R-G20E-N76D-S78N-G118R-H249R | 187 |
| GG36-09899 | S24R-N76D-S78N-G118R-S128L-P129Q-S130A | 188 |
| GG36-09900 | N76D-S78N-G118R-S128L-P129Q-S130A-Q206L-H249R | 189 |
| GG36-09907 | S24R-N76D-S78N-G118R-Q206L | 190 |
| GG36-09908 | N18R-N76D-S78N-S128L-P129Q-S130A-Q206L-V268A | 191 |
| GG36-09913 | N18R-N76D-S78N-S87R-Q206L-N218S-M222Q-H249R | 192 |

EXAMPLE 3

ADW Cleaning Performance And Stability of GG36 Protease Variants

GG36 variants generated as described in Example 2 above were screened in MTP assays (as described in Example 1) to compare their cleaning performance and stability to Parent. Results are shown in Tables 5 and 6. Cleaning performance was measured using Composition A at pH 11, and PAS38 egg yolk soil swatches, at 19 gpg and 50° C. Cleaning performance was measured using Composition A and B at pH 11, and PAS38 egg yolk soil swatches, at 7 gpg and 20° C. Enzyme stability was measured by DMC hydrolysis after stress, either at 19 gpg and temperatures ranging from 56-71° C., or at 1 gpg and temperatures ranging from 4857° C. The specific activity was measured using skim milk as substrate. The acronym "ND" used throughout the tables means that the value was either not determined, or the results are being omitted because the value obtained was too low to have confidence in the value.

TABLE 5

ADW Cleaning Performance, Stability And Specific Activity Of GG36 Variants Compared To Parent, Reported As PI

| | Egg yolk swatch cleaning | | Thermostability in Detergent | | Specific activity |
|---|---|---|---|---|---|
| Sample ID | 19 gpg, 50° C. | 7 gpg, 20° C. | 19 gpg | 1 gpg | Skim Milk |
| GG36 | 1.0 | 1.0 | 1.0 | 1.0 | 1.0 |
| JV0001 | 0.9 | 1.0 | 3.1 | 3.7 | 1.7 |
| JV0003 | 3.9 | ND | 4.3 | 5 | ND |
| JV0004 | 1.00 | ND | 7.9 | 9.3 | ND |
| JV0006 | 3.7 | ND | 11 | 12 | ND |
| JV0008 | 0.6 | ND | 17 | 16 | ND |
| JV0009 | 1.0 | 1.2 | 100 | 76 | 1.7 |
| JV0012 | 3.9 | ND | 28 | 26 | ND |
| JV0019 | 1.1 | ND | 250 | 170 | 0.7 |
| JV0058 | 0.8 | ND | 240 | 170 | 1.7 |
| JV0059 | 0.9 | ND | 130 | 130 | 2.1 |
| JV0060 | 0.4 | ND | 230 | 160 | 1.5 |
| JV0067 | 0.6 | ND | 260 | 210 | 0.9 |
| JV0068 | 0.6 | ND | 120 | 130 | 1.9 |
| JV0069 | 0.7 | ND | 210 | 160 | 2 |
| JV0071 | 0.8 | ND | 41 | 72 | 2.2 |
| JV0072 | 0.9 | ND | 50 | 82 | 2.3 |
| JV0073 | 0.6 | ND | 48 | 91 | 2.6 |
| JV0098 | 1.3 | ND | 110 | 120 | 1.6 |
| JV0099 | 1.7 | ND | 150 | 140 | 1.2 |
| JV0100 | 0.8 | ND | 130 | 120 | 2.2 |
| JV0104 | 0.8 | ND | 150 | 140 | 2.1 |
| JV0105 | 0.7 | ND | 240 | 190 | 1.3 |
| JV0113 | 0.6 | ND | 240 | 180 | 1.4 |
| JV0114 | 0.5 | ND | 200 | 150 | 1.4 |
| JV0117 | ND | 1.2 | 61 | 53 | 1.6 |
| JV0118 | ND | 1.1 | 47 | 50 | 1.4 |
| JV0119 | ND | 1.0 | 45 | 59 | 1.4 |
| JV0120 | ND | 1.1 | 80 | 72 | 1.2 |
| JV0121 | ND | 1.0 | 49 | 43 | 1.4 |
| JV0122 | ND | 0.9 | 200 | 89 | 1.5 |
| JV0123 | ND | 0.9 | 120 | 72 | 1.5 |
| JV0125 | ND | 1.3 | 260 | 110 | 1.5 |
| JV0126 | ND | 1.6 | 210 | 88 | 1.6 |
| JV0127 | ND | 1.6 | 220 | 110 | 1.7 |
| JV0131 | ND | 2.2 | 32 | 95 | 0.6 |
| JV0133 | ND | 0.9 | 130 | 71 | 1.8 |
| JV0134 | ND | 2.3 | 230 | 110 | 0.7 |
| JV0135 | ND | 3.3 | 310 | 120 | 0.6 |
| JV0148 | 0.9 | ND | 57 | 66 | 1.2 |
| JV0149 | 0.7 | ND | 128 | 146 | 0.7 |
| JV0196 | 0.9 | ND | 17 | 69 | 1.4 |
| JV0198 | 0.7 | 0.5 | 51 | 74 | 1.3 |
| JV0199 | 0.8 | ND | 71 | 108 | 1.0 |
| JV0200 | 0.8 | ND | 59 | 111 | 1.0 |

TABLE 5-continued

ADW Cleaning Performance, Stability And Specific Activity Of GG36 Variants Compared To Parent, Reported As PI

| Sample ID | Egg yolk swatch cleaning 19 gpg, 50° C. | Thermostability in Detergent 7 gpg, 20° C. | Egg yolk swatch cleaning 19 gpg | Thermostability in Detergent 1 gpg | Specific activity Skim Milk |
|---|---|---|---|---|---|
| JV0201 | 0.7 | ND | 81 | 99 | 1.1 |
| JV0202 | 0.9 | ND | 33 | 28 | 1.3 |
| JV0203 | 0.8 | ND | 49 | 43 | 1.2 |
| JV0204 | 0.6 | ND | 61 | 48 | 1.2 |
| JV0205 | 0.8 | ND | 84 | 97 | 1.0 |
| JV0206 | 0.8 | ND | 94 | 106 | 1.1 |
| JV0207 | 0.7 | ND | 96 | 113 | 1.1 |
| JV0239 | 0.4 | ND | 10 | 32 | 0.8 |
| JV0240 | 0.4 | ND | 13 | 38 | 0.8 |
| JV0241 | 0.3 | ND | 46 | 25 | 0.9 |
| JV0242 | 0.3 | ND | 62 | 28 | 0.8 |
| JV0243 | 0.5 | ND | 34 | 22 | 0.8 |
| JV0253 | 0.7 | ND | 56 | 54 | 1.2 |
| JV0254 | 0.9 | ND | 92 | 99 | 1.2 |
| JV0255 | 1.0 | ND | 70 | 60 | 1.5 |
| JV0260 | 1.0 | ND | 57 | 58 | 1.4 |
| JV0262 | 1.0 | ND | 48 | 52 | 1.5 |
| JV0263 | 0.9 | ND | 35 | 55 | 1.3 |
| JV0304 | 0.6 | ND | 25 | 6 | 0.9 |
| JV0309 | 0.6 | ND | 46 | 35 | 0.9 |
| JV0310 | 0.4 | ND | 11 | 10 | 1.1 |
| JV0354 | 0.9 | ND | 15 | 73 | 1.4 |
| JV0355 | 1.1 | ND | 25 | 13 | 1.5 |
| JV0356 | 0.9 | ND | 59 | 47 | 1.0 |
| GG36-09606 | 0.7 | ND | 17 | 18 | 1.1 |
| GG36-09610 | 1.0 | ND | 17 | 7 | 1.6 |
| GG36-09615 | 0.8 | ND | 17 | 7 | 1.2 |
| GG36-09621 | 1.0 | ND | 17 | 15 | 1.0 |
| GG36-09625 | 0.9 | ND | 20 | 30 | 0.7 |
| GG36-09629 | 1.1 | ND | 22 | 26 | 2.0 |
| GG36-09634 | 0.8 | ND | 19 | 20 | 1.4 |
| GG36-09667 | 0.7 | ND | 18 | 34 | 0.6 |
| GG36-09846 | 0.7 | ND | 13 | 15 | 1.8 |
| GG36-13631 | 0.4 | 0.4 | ND | 12 | ND |
| GG36-13662 | 0.7 | 0.9 | 30 | 26 | ND |
| GG36-13663 | 0.5 | 0.6 | 64 | 56 | ND |
| GG36-13667 | 0.5 | 0.6 | 79 | 25 | ND |
| GG36-13674 | 1.0 | 1.1 | ND | ND | ND |
| GG36-13679 | 1.0 | 1.0 | 47 | 24 | ND |
| GG36-13687 | 0.3 | 0.4 | ND | 14 | ND |
| GG36-13691 | 0.5 | 0.9 | 25 | 15 | ND |
| GG36-13696 | 0.9 | 1.0 | 29 | 25 | ND |
| GG36-13703 | 0.8 | 0.9 | 40 | 32 | ND |
| GG36-13711 | 0.7 | 0.7 | 18 | 14 | ND |
| GG36-13719 | 1.2 | 1.0 | ND | ND | ND |
| GG36-13724 | 0.4 | 0.5 | 17 | ND | ND |
| GG36-13767 | 1.3 | 0.7 | ND | ND | ND |
| GG36-13791 | 0.2 | 0.3 | 42 | 24 | ND |
| GG36-13796 | 0.4 | 0.4 | 49 | 15 | ND |
| GG36-13802 | 0.4 | 0.5 | ND | 11 | ND |
| GG36-13803 | 0.7 | 0.5 | ND | 34 | ND |
| GG36-13807 | 0.9 | 0.8 | 24 | 48 | ND |
| GG36-13819 | 0.3 | 0.4 | ND | 11 | ND |
| GG36-13831 | 0.7 | 0.7 | ND | 15 | ND |
| GG36-13851 | 1.0 | 0.7 | 46 | 29 | ND |
| GG36-13855 | 0.4 | 0.3 | 81 | 51 | ND |
| GG36-13859 | 0.6 | 0.4 | 94 | 39 | ND |
| GG36-13864 | 0.6 | 0.3 | 21 | 17 | ND |
| GG36-13867 | 0.8 | 0.5 | 43 | 71 | ND |
| GG36-13872 | 1.1 | 0.9 | ND | ND | ND |
| GG36-13875 | 0.6 | 0.6 | 29 | 21 | ND |
| GG36-13879 | 0.7 | 0.6 | 28 | 19 | ND |
| GG36-13886 | 0.5 | 0.5 | 40 | 30 | ND |
| GG36-13893 | 0.6 | 0.7 | 53 | 39 | ND |
| GG36-13895 | 0.7 | 0.8 | ND | 12 | ND |
| GG36-13899 | 0.6 | 0.6 | 32 | 17 | ND |
| GG36-13911 | 0.7 | 0.5 | 32 | 13 | ND |
| GG36-13924 | 0.3 | 0.3 | 25 | 18 | ND |
| GG36-13928 | 0.5 | 0.4 | 25 | ND | ND |
| GG36-13935 | 0.7 | 0.4 | ND | 23 | ND |
| GG36-13939 | 0.6 | 0.5 | ND | 16 | ND |
| GG36-13953 | 0.2 | 0.5 | ND | 10 | ND |
| GG36-13958 | 0.5 | 0.7 | ND | 14 | ND |
| GG36-13963 | 0.7 | 0.8 | ND | 14 | ND |
| GG36-14040 | 1.8 | 1.9 | ND | ND | ND |
| GG36-14051 | 1.5 | 1.5 | ND | ND | ND |
| GG36-14064 | 1.5 | 2.0 | ND | ND | ND |
| GG36-14069 | 1.1 | 1.0 | 17 | 15 | ND |
| GG36-14072 | 1.3 | 1.3 | 24 | ND | ND |
| GG36-14075 | 2.4 | 3.0 | ND | ND | ND |
| GG36-14079 | 1.3 | 1.2 | ND | 35 | ND |
| GG36-14083 | 1.5 | 1.6 | ND | 13 | ND |
| GG36-14088 | 1.5 | 1.4 | ND | ND | ND |
| GG36-14095 | 1.1 | 1.3 | ND | ND | ND |
| GG36-14099 | 2.6 | 2.1 | ND | 13 | ND |
| GG36-14103 | 1.6 | 1.0 | ND | ND | ND |
| GG36-14107 | 2.5 | 2.0 | ND | 14 | ND |
| GG36-14111 | 1.3 | 1.7 | ND | 11 | ND |
| GG36-14115 | 0.7 | 0.9 | ND | 15 | ND |
| GG36-14120 | 2.1 | 2.2 | ND | ND | ND |
| GG36-14139 | 0.5 | 0.5 | 15 | 13 | ND |
| GG36-14149 | 0.9 | 1.0 | ND | 12 | ND |
| GG36-14155 | 0.8 | 0.9 | ND | 10 | ND |
| GG36-14176 | 1.2 | 1.3 | ND | ND | ND |
| GG36-14187 | 0.3 | 0.2 | 82 | 59 | ND |
| GG36-14192 | 0.4 | 0.3 | 91 | 46 | ND |
| GG36-14204 | 0.6 | 0.4 | 67 | 41 | ND |
| GG36-14207 | 0.3 | 0.4 | ND | 38 | ND |
| GG36-14211 | 0.2 | 0.2 | 38 | 27 | ND |
| GG36-14215 | 0.3 | 0.3 | 38 | 21 | ND |
| GG36-14219 | 0.5 | 0.5 | 56 | 40 | ND |
| GG36-14227 | 0.5 | 0.4 | 60 | 43 | ND |
| GG36-14232 | 0.3 | 0.3 | ND | 24 | ND |
| GG36-14236 | 0.4 | 0.5 | 42 | 20 | ND |
| GG36-14246 | 0.5 | 0.3 | 20 | 10 | ND |
| GG36-14248 | 0.3 | 0.3 | 45 | 16 | ND |
| GG36-14271 | 1.0 | 0.9 | ND | 14 | ND |
| GG36-14295 | 0.6 | 0.4 | ND | 17 | ND |
| GG36-14301 | 0.2 | 0.2 | ND | ND | ND |
| GG36-14401 | 0.6 | 0.5 | 16 | 14 | ND |
| GG36-14427 | 0.6 | 0.7 | ND | 10 | ND |
| GG36-14444 | 0.1 | 0.2 | 21 | 18 | ND |
| GG36-14447 | 0.3 | 0.2 | 16 | ND | ND |
| GG36-14459 | 0.2 | 0.2 | ND | 10 | ND |
| GG36-14463 | 0.6 | 0.6 | 18 | 19 | ND |
| GG36-14467 | 0.7 | 0.8 | 17 | 10 | ND |
| GG36-14478 | 0.8 | 0.7 | 73 | 42 | ND |

TABLE 6

ADW Cleaning Performance, Stability And Specific Activity Of GG36 Variants Compared To Parent, Reported As PI

| Sample ID | Egg yolk swatch cleaning 19 gpg, 50° C. | Thermostability in Detergent 7 gpg, 20° C. | Egg yolk swatch cleaning 19 gpg | Thermostability in Detergent 1 gpg | Specific activity Skim Milk |
|---|---|---|---|---|---|
| GG36 | 1.0 | 1.0 | 1.0 | 1.0 | 1.0 |
| JV0005 | 4.3 | ND | 12 | 17 | ND |
| JV0007 | 2.8 | ND | 6.1 | 9.4 | ND |
| JV0011 | 3.5 | ND | 26 | 38 | ND |
| JV0014 | 2.0 | ND | 3.1 | 5.2 | ND |
| JV0017 | 1.9 | ND | 3.3 | 3.3 | ND |
| JV0024 | 0.2 | ND | 22 | 20 | ND |
| JV0025 | 0.2 | ND | 36 | 37 | ND |
| JV0028 | 2.5 | ND | 31 | 27 | ND |
| JV0029 | 1.0 | ND | 240 | 150 | 1.2 |

TABLE 6-continued

ADW Cleaning Performance, Stability And Specific Activity Of GG36 Variants Compared To Parent, Reported As PI

| Sample ID | Egg yolk swatch cleaning 19 gpg, 50° C. | 7 gpg, 20° C. | Thermostability in Detergent 19 gpg | 1 gpg | Specific activity Skim Milk |
|---|---|---|---|---|---|
| JV0030 | 0.2 | ND | 210 | 170 | 1.1 |
| JV0031 | 0.8 | ND | 100 | 110 | 1.9 |
| JV0034 | 0.8 | ND | 240 | 170 | 1.7 |
| JV0035 | 0.7 | ND | 210 | 150 | 1.0 |
| JV0036 | 0.9 | ND | 130 | 120 | 2.2 |
| JV0037 | 0.6 | ND | 78 | 110 | 1.7 |
| JV0038 | 0.6 | ND | 89 | 92 | 1.7 |
| JV0039 | 0.9 | ND | 50 | 68 | 0.8 |
| JV0040 | 0.9 | ND | 42 | 54 | 1.4 |
| JV0041 | 0.8 | ND | 250 | 160 | 1.1 |
| JV0042 | 1.0 | ND | 61 | 64 | 1.4 |
| JV0043 | 0.8 | ND | 260 | 170 | 0.7 |
| JV0044 | 1.2 | ND | 270 | 170 | 1.1 |
| JV0045 | 1.0 | ND | 250 | 150 | 1.3 |
| JV0046 | 1.2 | ND | 230 | 150 | 0.9 |
| JV0047 | 0.6 | ND | 81 | 150 | 0.3 |
| JV0048 | 1.0 | ND | 200 | 110 | 0.9 |
| JV0049 | 1.2 | ND | 90 | 170 | 0.7 |
| JV0050 | 0.9 | ND | 96 | 180 | 0.6 |
| JV0052 | 1.1 | ND | 250 | 160 | 1.1 |
| JV0053 | 1.6 | ND | 36 | 31 | ND |
| JV0054 | 1.6 | ND | 37 | 37 | ND |
| JV0055 | 2.9 | ND | 32 | 32 | ND |
| JV0056 | 2.9 | ND | 4.1 | 12 | ND |
| JV0057 | 3.4 | ND | 44 | 28 | ND |
| JV0062 | 1.4 | ND | 26 | 32 | 1.1 |
| JV0063 | 1.4 | ND | 160 | 140 | 0.5 |
| JV0064 | 1.0 | ND | 220 | 140 | 1.0 |
| JV0065 | 0.9 | ND | 200 | 150 | 1.4 |
| JV0066 | 1.3 | ND | 85 | 71 | 0.8 |
| JV0074 | 1.1 | ND | 280 | 180 | 1.5 |
| JV0075 | 1.1 | ND | 280 | 180 | 0.9 |
| JV0078 | 0.9 | ND | 240 | 170 | 1.5 |
| JV0079 | 1.0 | ND | 260 | 200 | 1.1 |
| JV0081 | 1.0 | ND | 250 | 180 | 1.3 |
| JV0085 | 0.5 | ND | 300 | 180 | 0.9 |
| JV0086 | 1.1 | ND | 200 | 170 | 1.5 |
| JV0088 | 1.7 | ND | 24 | 47 | 1.8 |
| JV0089 | 1.5 | ND | 130 | 120 | 1.6 |
| JV0090 | 1.4 | ND | 130 | 94 | 1.0 |
| JV0095 | 1.1 | ND | 270 | 180 | 1.1 |
| JV0096 | 1.1 | ND | 270 | 180 | 1.2 |
| JV0097 | 1.1 | ND | 210 | 190 | 1.2 |
| JV0101 | 0.4 | ND | 220 | 160 | 1.6 |
| JV0102 | 0.9 | ND | 180 | 150 | 1.1 |
| JV0103 | 0.9 | ND | 260 | 190 | 1.2 |
| JV0106 | 0.6 | ND | 220 | 170 | 1.3 |
| JV0108 | 0.6 | ND | 240 | 180 | 1.6 |
| JV0109 | 0.7 | ND | 140 | 140 | 1.2 |
| JV0110 | 0.9 | ND | 180 | 160 | 1.0 |
| JV0111 | 0.6 | ND | 190 | 170 | 1.1 |
| JV0112 | 0.6 | ND | 170 | 150 | 1.4 |
| JV0128 | ND | 1.0 | 270 | 130 | 1.5 |
| JV0129 | ND | 1.0 | 280 | 130 | 1.6 |
| JV0130 | ND | 1.0 | 370 | 140 | 1.9 |
| JV0136 | ND | 2.9 | 81 | 160 | 0.3 |
| JV0137 | ND | 1.3 | 15 | 5.6 | 1.8 |
| JV0138 | ND | 0.4 | 290 | 130 | 2.0 |
| JV0139 | ND | 3.8 | 59 | 140 | 1.0 |
| JV0150 | 1.0 | ND | 128 | 172 | 0.5 |
| JV0152 | 1.0 | ND | 109 | 155 | 0.7 |
| JV0193 | 0.7 | ND | 10 | 4 | 0.6 |
| JV0208 | 1.5 | ND | 81 | 103 | 0.9 |
| JV0209 | 1.3 | ND | 78 | 97 | 0.8 |
| JV0210 | 0.9 | ND | 90 | 123 | 0.4 |
| JV0211 | 1.1 | ND | 65 | 97 | 0.7 |
| JV0212 | 0.8 | ND | 86 | 127 | 0.5 |
| JV0213 | 1.2 | ND | 114 | 153 | 0.7 |
| JV0214 | 1.0 | ND | 80 | 104 | 0.6 |
| JV0215 | 0.7 | ND | 56 | 130 | 0.6 |
| JV0216 | 0.8 | ND | 73 | 139 | 0.6 |
| JV0217 | 0.9 | ND | 72 | 130 | 0.6 |
| JV0218 | 0.8 | ND | 86 | 150 | 0.5 |
| JV0219 | 1.0 | ND | 79 | 139 | 0.5 |
| JV0221 | 1.0 | ND | 96 | 120 | 0.6 |
| JV0222 | 1.0 | ND | 94 | 134 | 0.8 |
| JV0223 | 0.8 | ND | 95 | 151 | 0.5 |
| JV0224 | 0.7 | ND | 94 | 144 | 0.4 |
| JV0225 | 1.0 | ND | 83 | 128 | 0.5 |
| JV0226 | 0.8 | ND | 80 | 132 | 0.5 |
| JV0227 | 0.7 | ND | 46 | 129 | 0.7 |
| JV0228 | 0.9 | ND | 69 | 143 | 0.7 |
| JV0229 | 0.8 | ND | 57 | 119 | 0.6 |
| JV0230 | 0.8 | ND | 96 | 139 | 1.0 |
| JV0231 | 0.8 | ND | 87 | 126 | 0.6 |
| JV0232 | 0.8 | ND | 84 | 129 | 0.8 |
| JV0233 | 0.7 | ND | 78 | 140 | 0.8 |
| JV0234 | 0.6 | ND | 94 | 127 | 0.6 |
| JV0235 | 0.9 | ND | 71 | 127 | 0.5 |
| JV0236 | 0.8 | ND | 65 | 124 | 0.6 |
| JV0237 | 1.0 | ND | 128 | 134 | 0.6 |
| JV0238 | 1.1 | ND | 77 | 96 | 0.6 |
| JV0257 | 1.0 | ND | 24 | 40 | 0.4 |
| JV0258 | 1.5 | ND | 2 | 6 | 0.8 |
| JV0261 | 1.3 | ND | 32 | 44 | 0.5 |
| JV0264 | 1.4 | ND | 16 | 16 | 0.5 |
| JV0265 | 1.5 | ND | 15 | 32 | 0.8 |
| JV0266 | 1.4 | ND | 19 | 12 | 0.8 |
| JV0276 | 1.3 | ND | 79 | 45 | 0.9 |
| JV0277 | 0.7 | ND | 86 | 110 | 0.6 |
| JV0278 | 0.9 | ND | 72 | 54 | 0.8 |
| JV0280 | 0.8 | ND | 86 | 137 | 0.7 |
| JV0281 | 0.7 | ND | 88 | 105 | 0.6 |
| JV0282 | 1.0 | ND | 59 | 97 | 0.8 |
| JV0283 | 0.9 | ND | 67 | 93 | 0.9 |
| JV0285 | 0.9 | ND | 92 | 101 | 0.9 |
| JV0286 | 0.8 | ND | 87 | 106 | 0.7 |
| JV0287 | 1.2 | ND | 83 | 137 | 0.8 |
| JV0288 | 0.7 | ND | 95 | 102 | 0.7 |
| JV0289 | 0.8 | ND | 80 | 44 | 0.7 |
| JV0290 | 1.0 | ND | 107 | 114 | 0.5 |
| JV0291 | 0.4 | ND | 64 | 101 | 0.5 |
| JV0292 | 1.0 | ND | 49 | 97 | 0.8 |
| JV0293 | 0.9 | ND | 87 | 119 | 0.7 |
| JV0294 | 1.0 | ND | 98 | 109 | 0.8 |
| JV0297 | 0.3 | ND | 111 | 96 | 0.9 |
| JV0299 | 0.2 | ND | 117 | 131 | 0.8 |
| JV0301 | 0.4 | ND | 88 | 105 | 1.3 |
| JV0302 | 0.6 | ND | 93 | 93 | 1.3 |
| JV0303 | 0.4 | ND | 106 | 124 | 1.0 |
| JV0307 | ND | ND | 9 | ND | 0.4 |
| JV0312 | 0.6 | ND | 45 | 36 | 0.5 |
| JV0313 | 1.0 | ND | 14 | 12 | 0.9 |
| JV0336 | 0.7 | ND | 110 | 136 | 0.4 |
| JV0339 | 0.8 | ND | 96 | 127 | 0.6 |
| JV0348 | 0.2 | ND | 118 | 149 | 0.5 |
| JV0357 | 1.0 | ND | 89 | 137 | 0.9 |
| GG36-08640 | 2.2 | ND | 28 | 29 | ND |
| GG36-08712 | 3.1 | ND | 8.4 | 20 | ND |
| GG36-08714 | 6.1 | ND | 7.9 | 11 | ND |
| GG36-08717 | 5.5 | ND | 6.6 | 18 | ND |
| GG36-08725 | 2.5 | ND | 12 | 14 | ND |
| GG36-08729 | 5.3 | ND | 13 | 22 | ND |
| GG36-08734 | 3.9 | ND | 14 | 17 | ND |
| GG36-08740 | 3.6 | ND | 5.3 | 7.1 | ND |
| GG36-08748 | 6.0 | ND | 8.6 | 23 | ND |
| GG36-08751 | 5.8 | ND | 6.3 | 20 | ND |
| GG36-08772 | 0.9 | ND | 35 | 37 | ND |
| GG36-08778 | 5.2 | ND | 11 | 15 | ND |
| GG36-08839 | 2.1 | ND | 12 | 23 | ND |
| GG36-08866 | 2.8 | ND | 30 | 32 | ND |
| GG36-08884 | 3.7 | ND | 30 | 35 | ND |

TABLE 6-continued

ADW Cleaning Performance, Stability And Specific Activity Of GG36 Variants Compared To Parent, Reported As PI

| Sample ID | Egg yolk swatch cleaning 19 gpg, 50° C. | 7 gpg, 20° C. | Thermostability in Detergent 19 gpg | 1 gpg | Specific activity Skim Milk |
|---|---|---|---|---|---|
| GG36-08894 | 1.3 | ND | 36 | 37 | ND |
| GG36-08902 | 0.9 | ND | 27 | 32 | ND |
| GG36-08903 | 1.1 | ND | 30 | 37 | ND |
| GG36-08904 | 3.5 | ND | 3.2 | 5.5 | ND |
| GG36-08940 | 0.5 | ND | 36 | 37 | ND |
| GG36-08941 | 1.0 | ND | 6.8 | 20 | ND |
| GG36-09154 | 2.1 | ND | 5.1 | 5.7 | ND |
| GG36-09175 | 0.8 | ND | 34 | 36 | ND |
| GG36-09189 | 1.0 | ND | 31 | 30 | ND |
| GG36-09201 | 0.7 | ND | 35 | 37 | ND |
| GG36-09213 | 1.4 | ND | 32 | 34 | ND |
| GG36-09237 | 4.0 | ND | 4.8 | 4.0 | ND |
| GG36-09242 | 1.8 | ND | 36 | 37 | ND |
| GG36-09278 | 3.8 | ND | 25 | 34 | ND |
| GG36-09333 | 2.2 | ND | 40 | 30 | ND |
| GG36-09339 | 0.5 | ND | 33 | 45 | ND |
| GG36-09341 | 2.8 | ND | 23 | 23 | ND |
| GG36-09412 | 5.8 | ND | 8.3 | 14 | ND |
| GG36-09413 | 2.2 | ND | 7.3 | 7.8 | ND |
| GG36-09426 | 4.4 | ND | 10 | 10 | ND |
| GG36-09642 | 0.9 | ND | 19 | 58 | 1.0 |
| GG36-09645 | 0.9 | ND | 19 | 62 | 1.1 |
| GG36-09646 | 0.8 | ND | 17 | 41 | 0.6 |
| GG36-09649 | 1.0 | ND | 17 | 17 | 1.7 |
| GG36-09653 | 0.8 | ND | 13 | 3.9 | 0.6 |
| GG36-09656 | 0.8 | ND | 20 | 42 | 1.5 |
| GG36-09659 | 0.9 | ND | 17 | 49 | 1.1 |
| GG36-09662 | 0.8 | ND | 15 | 21 | 1.1 |
| GG36-09672 | 0.9 | ND | 17 | 50 | 0.6 |
| GG36-09674 | 0.9 | ND | 17 | 45 | 0.5 |
| GG36-09676 | 0.8 | ND | 18 | 11 | 0.9 |
| GG36-09842 | 0.7 | ND | 18 | 43 | 0.9 |
| GG36-09844 | 0.7 | ND | 16 | 47 | 1.6 |
| GG36-09845 | 0.8 | ND | 10 | 40 | 1.3 |
| GG36-09852 | 0.8 | ND | 11 | 18 | 2.1 |
| GG36-09857 | 0.7 | ND | 18 | 57 | 0.8 |
| GG36-09862 | 0.7 | ND | 14 | 11 | 0.9 |
| GG36-09873 | 0.7 | ND | 18 | 58 | 0.7 |
| GG36-09875 | 0.5 | ND | 18 | 43 | 0.5 |
| GG36-09880 | 0.7 | ND | 18 | 44 | 0.7 |
| GG36-09882 | 0.3 | ND | 15 | 12 | 0.5 |
| GG36-09885 | 0.7 | ND | 16 | 34 | 1.6 |
| GG36-09886 | 0.7 | ND | 16 | 38 | 0.8 |
| GG36-09890 | 0.8 | ND | 18 | 19 | 1.8 |
| GG36-09896 | 0.7 | ND | 8.9 | 33 | 0.9 |
| GG36-09899 | 0.7 | ND | 16 | 41 | 1.6 |
| GG36-09900 | 0.8 | ND | 18 | 21 | 1.3 |
| GG36-09907 | 0.7 | ND | 17 | 39 | 0.8 |
| GG36-09908 | 0.6 | ND | 17 | 56 | 1.1 |
| GG36-09913 | 0.6 | ND | 22 | 170 | 0.7 |

EXAMPLE 4

Laundry Cleaning Performance And Stability of GG36 Protease Variants

GG36 variants generated as described in Example 2 above were screened in MTP assays (as described in Example 1) to compare their cleaning performance and stability to Parent. Results are shown in Tables 7 and 8. Cleaning performance was measured using liquid detergent TIDE® (Original scent, Procter and Gamble), and EMPA-116 microswatches (blood/milk/ink on cotton) at 25° C. Enzyme thermostability in 10% TIDE® liquid detergent was measured by AAPF-pNA hydrolysis before and after a stress incubation for 5 minutes, at temperatures listed in Tables 7 and 8 (i.e. at 50° C., 59° C. and/or 61° C.). The acronym "ND" used throughout the tables means "not determined". In Tables 7 and 8, cleaning is reported as PI compared to parent, and stability is reported as percent remaining activity after stress.

TABLE 7

HDL Cleaning Performance And Stability Of GG36 Variants Compared To Parent

| Sample ID | Blood/Milk/Ink Swatch Cleaning PI Compared to GG36 | PI Compared to JV0001 | Thermostability Residual Activity in 10% TIDE® 50° C. | 59° C. | 61° C. |
|---|---|---|---|---|---|
| GG36 | 1.0 | 1.2 | 11% | <5% | <5% |
| JV0001 | 0.8 | 1.0 | 53% | <5% | <5% |
| JV0004 | 0.9 | 0.9 | ND | ND | 7% |
| JV0009 | 0.9 | 0.9 | ND | 47% | 33% |
| JV0019 | 0.1 | 0.1 | 100% | ND | ND |
| JV0058 | 0.8 | 0.9 | 100% | ND | ND |
| JV0059 | 0.3 | 0.4 | 90% | ND | ND |
| JV0060 | 0.4 | 0.4 | 99% | ND | ND |
| JV0067 | 0.1 | 0.2 | 100% | ND | ND |
| JV0068 | 0.6 | 0.7 | 99% | ND | ND |
| JV0069 | 0.4 | 0.4 | 100% | ND | ND |
| JV0071 | 0.4 | 0.4 | 88% | ND | ND |
| JV0072 | 0.2 | 0.3 | 99% | ND | ND |
| JV0073 | 0.3 | 0.3 | 100% | ND | ND |
| JV0098 | 0.4 | 0.4 | 100% | ND | ND |
| JV0099 | 0.1 | 0.1 | 98% | ND | ND |
| JV0100 | 0.3 | 0.4 | 90% | ND | ND |
| JV0104 | 0.5 | 0.6 | 97% | ND | ND |
| JV0105 | 0.5 | 0.5 | 98% | ND | ND |
| JV0113 | 0.3 | 0.4 | 96% | ND | ND |
| JV0114 | 0.1 | 0.1 | 100% | ND | ND |
| JV0148 | 0.9 | 0.8 | ND | 26% | 12% |
| JV0149 | 0.8 | 0.9 | ND | 54% | ND |
| JV0203 | 0.9 | 0.8 | ND | ND | 16% |
| JV0204 | 0.9 | 0.8 | ND | ND | 19% |
| JV0239 | 0.9 | 1.1 | ND | 11% | ND |
| JV0240 | 1.0 | 1.1 | ND | 15% | ND |
| JV0241 | 1.0 | 1.2 | ND | 20% | ND |
| JV0242 | 1.0 | 1.1 | ND | 44% | ND |
| JV0243 | 0.9 | 1.0 | ND | 31% | ND |
| JV0253 | 0.9 | 0.9 | ND | ND | 15% |
| JV0254 | 0.9 | 0.9 | ND | ND | 47% |
| JV0255 | 1.0 | 1.0 | ND | ND | 31% |
| JV0260 | 0.9 | 0.9 | ND | ND | 47% |
| JV0263 | 0.9 | 0.9 | ND | ND | 18% |
| GG36-13631 | 1.1 | 1.1 | ND | ND | ND |
| GG36-13641 | 1.2 | 1.2 | ND | ND | ND |
| GG36-13643 | 1.2 | 1.2 | ND | ND | ND |
| GG36-13647 | 1.2 | 1.2 | ND | ND | ND |
| GG36-13652 | 1.1 | 1.1 | ND | ND | ND |
| GG36-13663 | 1.2 | 1.2 | ND | ND | ND |
| GG36-13667 | 1.1 | 1.0 | ND | ND | ND |
| GG36-13735 | 1.2 | 1.2 | ND | ND | ND |
| GG36-13739 | 1.0 | 1.0 | ND | ND | ND |
| GG36-13767 | 1.0 | 1.0 | ND | ND | ND |
| GG36-13839 | 1.1 | 1.1 | ND | ND | ND |
| GG36-13851 | 1.1 | 1.0 | ND | ND | ND |
| GG36-13855 | 1.2 | 1.1 | ND | ND | ND |
| GG36-13859 | 1.1 | 1.1 | ND | ND | ND |
| GG36-13903 | 1.5 | 1.4 | ND | ND | ND |
| GG36-13919 | 1.1 | 1.1 | ND | ND | ND |
| GG36-13928 | 1.2 | 1.2 | ND | ND | ND |
| GG36-13943 | 1.2 | 1.2 | ND | ND | ND |
| GG36-14007 | 1.1 | 1.0 | ND | ND | ND |
| GG36-14136 | 1.1 | 1.0 | ND | ND | ND |
| GG36-14139 | 1.1 | 1.1 | ND | ND | ND |
| GG36-14144 | 1.2 | 1.2 | ND | ND | ND |
| GG36-14167 | 1.1 | 1.0 | ND | ND | ND |
| GG36-14192 | 1.1 | 1.0 | ND | ND | ND |
| GG36-14295 | 1.1 | 1.1 | ND | ND | ND |
| GG36-14301 | 1.2 | 1.2 | ND | ND | ND |
| GG36-14307 | 1.2 | 1.2 | ND | ND | ND |
| GG36-14311 | 1.2 | 1.2 | ND | ND | ND |
| GG36-14401 | 1.1 | 1.1 | ND | ND | ND |
| GG36-14439 | 1.1 | 1.1 | ND | ND | ND |

TABLE 7-continued

HDL Cleaning Performance And Stability Of GG36 Variants Compared To Parent

| Sample ID | Blood/Milk/Ink Swatch Cleaning PI Compared to GG36 | PI Compared to JV0001 | Thermostability Residual Activity in 10% TIDE® 50° C. | 59° C. | 61° C. |
|---|---|---|---|---|---|
| GG36-14444 | 1.1 | 1.1 | ND | ND | ND |
| GG36-14447 | 1.2 | 1.1 | ND | ND | ND |
| GG36-14451 | 1.1 | 1.0 | ND | ND | ND |
| GG36-14455 | 1.2 | 1.2 | ND | ND | ND |
| GG36-14459 | 1.2 | 1.2 | ND | ND | ND |

TABLE 8

HDL Cleaning Performance And Stability Of Additional GG36 Variants Compared To Parent

| Sample ID | Blood/Milk/Ink Swatch Cleaning PI compared to GG36 | PI compared to JV0001 | Thermostability Residual activity in 10% TIDE® 50° C. | 59° C. | 61° C. |
|---|---|---|---|---|---|
| GG36 | 1.0 | 1.2 | 11% | <5% | <5% |
| JV0025 | 0.4 | 0.5 | 100% | ND | ND |
| JV0030 | 0.4 | 0.4 | 100% | ND | ND |
| JV0031 | 0.6 | 0.8 | 100% | ND | ND |
| JV0036 | 0.3 | 0.3 | 100% | ND | ND |
| JV0037 | 0.4 | 0.4 | 82% | ND | ND |
| JV0039 | 0.2 | 0.2 | 76% | ND | ND |
| JV0040 | 0.5 | 0.6 | 91% | ND | ND |
| JV0041 | 0.3 | 0.3 | 100% | ND | ND |
| JV0048 | 0.2 | 0.2 | 75% | ND | ND |
| JV0062 | 0.2 | 0.3 | 88% | ND | ND |
| JV0063 | 0.2 | 0.2 | 96% | ND | ND |
| JV0065 | 0.2 | 0.2 | 100% | ND | ND |
| JV0074 | 0.1 | 0.1 | 100% | ND | ND |
| JV0079 | 0.5 | 0.6 | 100% | ND | ND |
| JV0081 | 0.3 | 0.4 | 100% | ND | ND |
| JV0085 | 0.3 | 0.4 | 100% | ND | ND |
| JV0086 | 0.1 | 0.2 | 96% | ND | ND |
| JV0089 | 0.4 | 0.4 | 98% | ND | ND |
| JV0090 | 0.2 | 0.2 | 100% | ND | ND |
| JV0095 | 0.2 | 0.3 | 97% | ND | ND |
| JV0096 | 0.5 | 0.6 | 100% | ND | ND |
| JV0097 | 0.2 | 0.2 | 100% | ND | ND |
| JV0101 | 0.5 | 0.7 | 99% | ND | ND |
| JV0102 | 0.4 | 0.5 | 89% | ND | ND |
| JV0103 | 0.2 | 0.2 | 96% | ND | ND |
| JV0106 | 0.4 | 0.5 | 93% | ND | ND |
| JV0108 | 0.7 | 0.8 | 97% | ND | ND |
| JV0109 | 0.3 | 0.3 | 45% | ND | ND |
| JV0110 | 0.3 | 0.4 | 93% | ND | ND |
| JV0111 | 0.4 | 0.4 | 100% | ND | ND |
| JV0112 | 0.4 | 0.4 | 85% | ND | ND |
| JV0150 | 0.5 | 0.6 | ND | 33% | ND |
| JV0152 | 0.7 | 0.8 | ND | 31% | ND |
| JV0189 | 0.6 | 0.5 | ND | ND | 40% |
| JV0208 | 0.5 | 0.5 | ND | ND | 66% |
| JV0209 | 0.5 | 0.5 | ND | ND | 62% |
| JV0210 | 0.4 | 0.4 | ND | ND | 66% |
| JV0211 | 0.5 | 0.6 | ND | 55% | ND |
| JV0212 | 0.4 | 0.4 | ND | 73% | ND |
| JV0213 | 0.5 | 0.6 | ND | 76% | ND |
| JV0214 | 0.3 | 0.3 | ND | 50% | ND |
| JV0215 | 0.9 | 1.0 | ND | 50% | ND |
| JV0216 | 0.5 | 0.5 | ND | 76% | ND |
| JV0217 | 0.5 | 0.5 | ND | 77% | ND |
| JV0218 | 0.4 | 0.5 | ND | 86% | ND |
| JV0219 | 0.5 | 0.6 | ND | 82% | ND |
| JV0221 | 0.6 | 0.6 | ND | 82% | ND |
| JV0222 | 0.5 | 0.6 | ND | 95% | ND |
| JV0223 | 0.4 | 0.5 | ND | 66% | ND |
| JV0224 | 0.2 | 0.2 | ND | 65% | ND |
| JV0225 | 0.3 | 0.4 | ND | 80% | ND |
| JV0226 | 0.4 | 0.5 | ND | 81% | ND |
| JV0227 | 0.9 | 1.1 | ND | 43% | ND |
| JV0228 | 1.1 | 1.3 | ND | 64% | ND |
| JV0229 | 1.0 | 1.1 | ND | 60% | ND |
| JV0230 | 1.0 | 1.1 | ND | 77% | ND |
| JV0231 | 1.0 | 1.1 | ND | 55% | ND |
| JV0232 | 1.0 | 1.2 | ND | 77% | ND |
| JV0233 | 0.9 | 1.0 | ND | 24% | ND |
| JV0234 | 0.7 | 0.8 | ND | 26% | ND |
| JV0235 | 0.8 | 0.9 | ND | 82% | ND |
| JV0236 | 1.0 | 1.1 | ND | 62% | ND |
| JV0237 | 0.5 | 0.5 | ND | 90% | ND |
| JV0238 | 0.5 | 0.5 | ND | 61% | ND |
| JV0258 | 0.3 | 0.3 | ND | ND | 23% |
| JV0264 | 0.2 | 0.2 | ND | ND | 54% |
| JV0265 | 0.4 | 0.4 | ND | ND | 24% |
| JV0266 | 0.4 | 0.4 | ND | ND | 37% |
| JV0276 | 0.5 | 0.5 | ND | ND | 64% |
| JV0277 | 0.6 | 0.6 | ND | ND | 69% |
| JV0281 | 0.6 | 0.6 | ND | ND | 58% |
| JV0282 | 0.7 | 0.7 | ND | ND | 41% |
| JV0283 | 0.8 | 0.8 | ND | ND | 43% |
| JV0285 | 0.8 | 0.8 | ND | ND | 50% |
| JV0286 | 0.8 | 0.8 | ND | ND | 81% |
| JV0287 | 0.5 | 0.5 | ND | ND | 103% |
| JV0288 | 0.6 | 0.6 | ND | ND | 72% |
| JV0289 | 0.7 | 0.7 | ND | ND | 42% |
| JV0290 | 0.4 | 0.4 | ND | ND | 85% |
| JV0291 | 0.6 | 0.6 | ND | ND | 51% |
| JV0292 | 0.8 | 0.8 | ND | ND | 29% |
| JV0293 | 0.7 | 0.7 | ND | ND | 23% |
| JV0294 | 0.7 | 0.7 | ND | ND | 12% |
| JV0297 | 1.0 | 1.0 | ND | ND | 12% |
| JV0299 | 0.9 | 0.9 | ND | ND | 47% |
| JV0301 | 1.1 | 1.1 | ND | ND | 63% |
| JV0302 | 1.0 | 1.0 | ND | ND | 51% |
| JV0303 | 1.0 | 1.0 | ND | ND | 19% |
| JV0307 | 0.2 | 0.2 | ND | ND | 25% |
| JV0312 | 0.2 | 0.2 | ND | ND | 19% |
| JV0313 | 0.4 | 0.4 | ND | ND | 5% |
| JV0336 | 1.0 | 0.9 | ND | ND | 60% |
| JV0339 | 1.1 | 1.0 | ND | ND | 14% |
| JV0348 | 1.1 | 1.0 | ND | ND | 82% |
| JV0357 | 0.8 | 0.8 | ND | ND | 19% |

EXAMPLE 5

Automatic Dishwashing Performance Evaluation of Protease Variants in Automatic Dishwashing Composition Test A One dose of detergent composition (Composition D), comprising 14.69 g of Composition C and 2.13 g of Composition B, was added to each automatic dishwasher at the opening of the dispenser drawer of each cycle.

The ADW compositions described in Table 9 were tested. When a protease was added to a composition of Table 9, the protease was added on a mgs of active enzyme per detergent dose. The proteases tested include JV0001, JV0008, JV0009, JV0024, and JV0025.

TABLE 9

ADW Compositions

| Example | Composition |
|---|---|
| Example A (nil protease) | Composition D |
| Comparative Example B | Composition D + 9.1 ppm JV0001 |
| Example C | Composition D + 9.1 ppm JV0008 |
| Example D | Composition D + 9.1 ppm JV0009 |
| Example E | Composition D + 9.1 ppm JV0024 |
| Example F | Composition D + 9.1 ppm JV0025 |

Test Stains

Two test stains were used of 6.5 cm×10 cm melamine tiles soiled with Egg Yolk (DM22) and Egg Yolk Milk (DM32), all supplied by the Centre for Testmaterials (Vlaardingen, The Netherlands).

Test Wash Procedure

TABLE 10

ADW Testing Conditions

| ADW Machine: | General Electric 2100 |
|---|---|
| Machine Cycle: | Normal Cycle |
| Main Wash volume: | 3.8 L |
| Maximum Water temperature: | 52.5° C. |
| Water hardness: | 1 gpg (US) |
| Rinse: | 1 rinse |

Composition C was dosed at 3866 ppm and Composition B was dosed at 553 ppm in a North American automatic dishwashing machine. Two tiles for each stain type were added to each automatic dishwashing machine. Four External replicates were carried out and an average stain removal performance for each stain in each ADW composition set forth in Table 9 was calculated (8 total replicates for each Table 9 composition). The cleaning performance of the Example A Composition (containing no protease enzyme) was taken as a reference for each test to calculate the delta SRI values. The stains were analyzed using image analysis, with results presented below calculated as percentage stain removal, i.e. Stain Removal Index (SRI) for the reference Example Composition A treatments, and change in SRI for each of the Example Composition B (Delta B), C (Delta C), D (Delta D), E (Delta E), and F (Delta F) treatments versus the reference Example Composition A treatments. Tukey's HSD multiple comparison procedure is used in order to control the overall error rate for all pairwise comparisons at 0.05 Stain Removal Index (SRI) is defined as: 0=no removal at all, 100=complete removal.

The performance index was also measured by calculating (the performance of each of the Example C, Example D, Example E and Example F Compositions minus the performance of the Example A Composition) divided by (performance of the Comparative Example B Composition minus the performance of the Example A Composition).

TABLE 11

Stain Removal of ADW Compositions Containing Amylase and Protease Enzymes

| | Absolute SRI | | Delta Stain Removal vs Example A | | | | | |
|---|---|---|---|---|---|---|---|---|
| Stain Type | Ex A | Comp. Ex B | Comp. Ex B | Ex C | Ex D | Ex E | Ex F | HSD |
| Egg Yolk | 11.4 | 20.3 | 8.9 | 21.8 | 30.1 | 37.7 | 78.4 | 11.7 |
| Egg Yolk/Milk | 14.6 | 23.5 | 8.9 | 30.5 | 43.4 | 41.8 | 80.5 | 11.4 |

TABLE 12

Performance Index for Egg Yolk/Milk (8 replicates)

| Example | Performance Index |
|---|---|
| Example A (nil protease) | — |
| Comparative Example B | 1 |
| Example C | 3.4 |
| Example D | 4.9 |
| Example E | 4.7 |
| Example F | 9.0 |

By comparing the samples washed with the composition of Example A (nil protease) with Example B (containing JV0001), C, D, E and F (containing JV0008, JV0009, JV0024 and JV0025, respectively), Table 11 indicates that JV0008, JV0009, JV0024 and JV0025 has improved stain removal performance.

By comparing the samples washed with the composition of example B (containing JV0001) with examples C, D, E and F (containing JV0008, JV0009, JV0024 and JV0025, respectively) taking Example A as the reference (nil protease enzyme), Table 12 indicates that JV0008, JV0009, JV0024 and JV0025 achieve a higher level of stain removal than JV0001.

Test B

One dose of detergent composition (Composition D), comprising 14.69 g of Composition C and 2.13 g of Composition B, was added to each automatic dishwasher at the opening of the dispenser drawer of each cycle.

The ADW compositions described in Table 13 were tested. When a protease was added to a composition of Table 13, the protease was added on a mgs of active enzyme per detergent dose. The proteases tested include JV0001 and JV0148.

TABLE 13

ADW Compositions

| Example | Composition |
|---|---|
| Example A (nil protease) | Composition D |
| Comparative Example B | Composition D + 9.1 ppm JV0001 |
| Example C | Composition D + 9.1 ppm JV0148 |

Test Stains

Two test stains were used of 6.5 cm×10 cm melamine tiles soiled with Egg Yolk (DM22) and Egg Yolk Milk (DM32), all supplied by the Centre for Testmaterials (Vlaardingen, The Netherlands).

Test Wash Procedures

TABLE 14

ADW Testing Conditions

| ADW Machine: | Whirlpool Maytag 8959 |
|---|---|
| Machine Cycle: | Heavy Cycle |
| Main Wash volume: | 3.8 L |
| Maximum Water temperature: | 63.5° C. |
| Water hardness: | 1 gpg (US) |
| Rinse: | 1 rinse |

Composition C was dosed at 3866 ppm and Composition B was dosed at 553 ppm in a North American automatic dishwashing machine. Two tiles for each stain type were added to each ADW machine. Four External replicates were carried out and an average stain removal performance for each stain in each Example composition was calculated (8 total replicates for each Example Composition). The cleaning performance of the Example A Composition (containing no protease enzyme) was taken as a reference for each test to calculate the delta SRI values. The stains were analyzed using image analysis, with results presented below calculated as percentage stain removal, i.e. Stain Removal Index (SRI) for the reference Example A Composition, and change in SRI for each of the Example Composition B (Delta B) and C (Delta C) treatments versus the reference Example Composition A treatments. Tukey's HSD multiple comparison procedure is used in order to control the overall error rate for all pairwise comparisons at 0.05 Stain Removal Index (SRI) is defined as: 0=no removal at all, 100=complete removal.

TABLE 15

Stain Removal of ADW Compositions Containing Amylase and Protease

| | Absolute SRI | | Delta Stain Removal vs Ex. A | | |
|---|---|---|---|---|---|
| Stain Type | Ex A | Comp. Ex B | Comp. Ex B | Comp. Ex C | HSD |
| Egg Yolk | 23.8 | 31.0 | 7.2 | 14.1 | 6.2 |
| Egg Yolk/Milk | 12.0 | 23.6 | 11.6 | 16.6 | 5.9 |

By comparing the samples washed with the composition of Example A (nil protease) with Example B (containing JV0001) and C (containing JV0148), Table 15 indicates that JV0148 has improved stain removal performance.

By comparing the samples washed with the composition of Example B (containing JV0001) with Example C (containing JV0148) according to Example A as the reference (nil protease enzyme), it is apparent that JV0148 achieved significantly higher levels of stain removal than JV0001.

Test C

One dose of detergent composition (Composition D), comprising 14.69 g of Composition C and 2.13 g of Composition B, was added to each automatic dishwasher at the opening of the dispenser drawer of each cycle.

The ADW compositions described in Table 16 were tested. When a protease was added to a composition of Table 16, the protease was added on a mgs of active enzyme per detergent dose. JV124 is the protease that was tested.

TABLE 16

ADW Compositions

| Example | Composition |
|---|---|
| Comparative Example A | Composition D + 9.1 ppm JV0001 |
| Example B | Composition D + 9.1 ppm JV0124 |

Test Stains

Two test stains were used of 6.5 cm×10 cm melamine tiles soiled with Egg Yolk (DM22) and Egg Yolk Milk (DM32), all supplied by the Centre for Testmaterials (Vlaardingen, The Netherlands).

Test Wash Procedures

TABLE 17

ADW Testing Conditions

| ADW Machine: | Whirlpool Maytag 8959 |
|---|---|
| Machine Cycle: | Heavy Cycle |
| Main Wash volume: | 3.8 L |
| Maximum Water temperature: | 63.5° C. |
| Water hardness: | 15 gpg (US) |
| Rinse: | 1 rinse |

Composition C was dosed at 3866 ppm and Composition B was dosed at 553 ppm in a North American automatic dishwashing machine. Two tiles for each stain type were added to each ADW machine. Four External replicates were carried out and an average stain removal performance for each stain in each Example composition was calculated (8 total replicates for each Example Composition). The cleaning performance of the Comparative Example A Composition was taken as a reference for each test to calculate the delta SRI values. The stains were analyzed using image analysis, with results presented below calculated as percentage stain removal, i.e. Stain Removal Index (SRI) for the Comparative Example A Composition, and change in SRI for the Example Composition B (Delta B) treatments versus the Comparative Example Composition A treatments. Tukey's HSD multiple comparison procedure is used in order to control the overall error rate for all pairwise comparisons at 0.05 Stain Removal Index (SRI) is defined as: 0=no removal at all, 100=complete removal.

TABLE 18

Stain Removal of ADW Compositions Containing Amylase and Protease

| | Absolute SRI | Delta Stain Removal vs Ex. A | |
|---|---|---|---|
| Stain Type | Comp. Ex A | Ex B | HSD |
| Egg Yolk | 70.1 | 19.7 | 13.5 |
| Egg Yolk/Milk | 40.0 | 52.5 | 14.9 |

By comparing the samples washed with the composition of Comparative Example A with Example B (containing JV104), Table 15 indicates that JV0104 has improved stain removal performance.

SEQUENCE LISTING (389 sequences)

SEQ ID NO: 1 - protein, 269 aa, Bacillus lentus
AQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 2 - protein, 275 aa, Bacillus amyloliquefaciens [sequence omitted]

SEQ ID NO: 3 - DNA, 810 bp, Bacillus lentus
gcgcaatcagtgccatggggaattagccgtgtgcaagccccagctgcccataaccgtggattgacaggttctggtgtaaaagttgctgtcctcgatacaggtatttccactcatccagacttaaatattcgtggtggcgctagctttgtaccaggggaaccatccactcaagatgggaatgggcatggcacgcatgtggccgggacgattgctgctttaaacaattcgattggcgttcttggcgtagcgccgagcgcggaactatacgctgttaaagtattaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctggaaattcaggtgcaggctcaatcagctatccggcccgttatgcgaacgcaatggcagtcggagctactgaccaaaacaacaaccgcgccagcttttcacagtatggcgcagggcttgacattgtcgcaccaggtgtaaacgtgcagagcacatacccaggttcaacgtatgccagcttaaacggtacatcgatggctactcctcatgttgcaggtgcagcagcccttgttaaacaaaagaacccatcttggtccaatgtacaaatccgcaatcatctaaagaatacggcaacgagcttaggaagcacgaacttgtatggaagcggacttgtcaatgcagaagctgcaactcgttaa

SEQ ID NO: 4 - DNA, 602 bp, Bacillus subtilis
tccattttcttctgctatcaaaataacagactcgtgattttccaaacgagctttcaaaaaagcctctgccccttgcaaatcggatgcctgtctataaaattcccgatattggttaaacagcggcgcaatggcggccgcatctgatgtctttgcttggcgaatgttcatcttatttcttcctccctctcaataattttttcattctatcccttttctgtaaagtttatttttcagaatacttttatcatcatgctttgaaaaaatatcacgataatatccattgttctcacggaagcacacgcaggtcatttgaacgaattttttcgacaggaatttgccgggactcaggagcatttaacctaaaaaagcatgacatttcagcataatgaacatttactcatgtctattttcgttcttttctgtatgaaaatagttatttcgagtctctacggaaatagcgagagatgatatacctaaatagagataaaatcatctcaaaaaaatgggtctactaaaatattattccatctattacaataaattcacagaatagtcttttaagtaagtctactctgaatttttttaaaaggagagggtaaaga

SEQ ID NO: 5 - DNA, 87 bp, Bacillus subtilis
gtgagaagcaaaaaattgtggatcagcttgttgtttgcgttaacgttaatctttacgatggcgttcagcaacatgtctgcgcaggct

SEQ ID NO: 6 - protein, 29 aa, Bacillus subtilis
VRSKKLWISLLFALTLIFTMAFSNMSAQA

SEQ ID NO: 7 - DNA, 2005 bp, artificial sequence
  synthetic construct
tccattttcttctgctatcaaaataacagactcgtgattttccaaacgagctttcaaaaaagcctctgccccttgcaaatcggatgcctgtctataaaattcccgatattggttaaacagcggcgcaatggcggccgcatctgatgtctttgcttggcgaatgttcatcttatttcttcctccctctcaataattttttcattctatcccttttctgtaaagtttatttttcagaatacttttatcatcatgctttgaaaaaatatcacgataatatccattgttctcacggaagcacacgcaggtcatttgaacgaattttttcgacaggaatttgccgggactcaggagcatttaacctaaaaaagcatgacatttcagcataatgaacatttactcatgtctattttcgttcttttctgtatgaaaatagttatttcgagtctctacggaaatagcgagagatgatatacctaaatagagataaaatcatctcaaaaaaatgggtctactaaaatattattccatctattacaataaattcacagaatagtcttttaagtaagtctactctgaatttttttaaaaggagagggtaaagagtgagaagcaaaaaattgtggatcagcttgttgtttgcgttaacgttaatctttacgatggcgttcagcaacatgtctgcgcaggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgagctcgatccagcgatttcttatattgaagaggatgcagaagtaacgacaatggcgcaatcagtgccatggggaattagccgtgtgcaagccccagctgcccataaccgtggattgacaggttctggtgtaaaagttgctgtcctcgatacaggtatttccactcatccagacttaaatattcgtggtggcgctagctttgtaccaggggaaccatccactcaagatgggaatgggcatggcacgcatgtggccgggacgattgctgctttaaacaattcgattggcgttcttggcgtagcgccgagcgcggaactatacgctgttaaagtattaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctggaaattcaggtgcaggctcaatcagctatccggcccgttatgcgaacgcaatggcagtcggagctactgaccaaaacaacaaccgcgccagcttttcacagtatggcgcagggcttgacattgtcgcaccaggtgtaaacgtgcagagcacatacccaggttcaacgtatgccagcttaaacggtacatcgatggctactcctcatgttgcaggtgcagcagcccttgttaaacaaaagaacccatcttggtccaatgtacaaatccgcaatcatctaaagaatacggcaacgagcttaggaagcacgaacttgtatggaagcggacttgtcaatgcagaagctgcaactcgttaataagcttacataaaaaaccggccttggccccgccggttttttattatttttcttcctccgcatgttcaatccgctccataatcgacggatggctccctctgaaaattttaacgagaaacggcgggttgacccggctcagtcccgtaacggccaagtcctgaaacgtctcaatcgccgcttcccggtttccggtcagctcaatgccgtaacggtcggcggcgttttcctgataccgggagacggcattcgtaatc

SEQ ID NO: 8 - DNA, 28 bp, artificial sequence
  PCR primer
agaggatgcagaagtaacgacaatggcg

SEQ ID NO: 9 - DNA, 27 bp, artificial sequence
  PCR primer
ccaaggccggttttttatgtaagctta

SEQ ID NO: 10 - DNA, 47 bp, artificial sequence
  PCR primer
cagaagctgcaactcgttaataagcttacataaaaaaccggccttgg

SEQ ID NO: 11 - DNA, 28 bp, artificial sequence
  PCR primer
cgccattgtcgttacttctgcatcctct

SEQ ID NO: 12 - DNA, 47 bp, artificial sequence
  PCR primer
gatagagctgggtaaagcctatgaattctccattttcttctgctatc

SEQ ID NO: 13 - DNA, 45 bp, artificial sequence
  PCR primer
ataggctttacccagctctatcacaaacgaaaattggataaagtg

SEQ ID NO: 14 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNSIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 15 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNSIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNRLKNTATSLGSTNLYGSGLVNAEAATR

SEQ ID NO: 16 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 17 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNRLKNTATSLGSTNLYGSGLVNAEAATR

SEQ ID NO: 18 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNSIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 19 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 20 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNRLKNTATSLGSTNLYGSGLVNAEAATR

SEQ ID NO: 21 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYPGSTYASLNGTSQATPHVAGAAALVKQKNPSWSNVQIRNHLKNTATSLGSTNLYGSGLVNAEAATR

SEQ ID NO: 22 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 23 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGVGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 24 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLTLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 25 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGDTYASLNGTSMATPHVAGAAALVKQKNPSWSNVQIRNHLKNTATSLGSTNLYGSGLVNAEAATR

SEQ ID NO: 26 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSIDYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 27 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNNIGVLGVAPRAELYAVKVLGASGGGAISSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 28 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSAYASLNGTSMATPHVAGAAALVKQKNPSWSNVQIRNHLKNTATSLGSTNLYGSGLVNAEAATR

SEQ ID NO: 29 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAVLVKQKNPSWSNVRIRNHLKNTATSLGSTNLYGSGLVNAEAATR

SEQ ID NO: 30 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGADSISYPARYANAMAVGATDQNNNRADFSQYGAGLDIVAPGVNVLSTYPGSTYASLNGTSMATPHVAGAAVLVKQKNPSWSNVRIRNHLKNTATSLGSTNLYGSGLVNAEAATR

SEQ ID NO: 31 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNRLKNTATSLGSTNLYGSGLVNAEAATR

SEQ ID NO: 32 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 33 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 34 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTWPGSTYASLNGTSMATPHVAGAAALVKQKNPSWSNVQIRNHLKNTATSLGSTNLYGSGLVNAEAATR

SEQ ID NO: 35 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTWPGSTYASLNGTSMATPHVAGAAALVKQKNPSWSNVQIRNHLKNTATSLGSTNLYGSGLVNAEAATR

SEQ ID NO: 36 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSSATPHVAGAAALVKQKNPSWSNVQIRNHLKNTATSLGSTNLYGSGLVNAEAATR

SEQ ID NO: 37 - protein, 269 aa, artificial sequence
  GG36 ;protease variant
AQTVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 38 - protein, 269 aa, artificial sequence
  GG36 ;protease variant
AQSVPWGISRVQAPAAHNRGLTGSGVKTAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 39 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSISQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 40 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGMNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 41 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANMSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 42 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVTAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 43 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGDGLDIVAPGVNVLSTYPGSTYASLNGTSMATPHVAGAAALVKQKNPSWSNVQIRNHLKNTATSLGSTNLYGSGLVNAEAATR

SEQ ID NO: 44 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGEGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 45 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 46 - protein, 269 aa, artificial sequence
  GG36 ;protease variant
AQSVPWGISRVQAPAAHNRGLTGSGVKTAVLDTGISTHPDLNIRGGASFVPGEPSTQDGNGHGTHVAGTIAALDNNIGVLGVAPRAELYAVKVLGASGFGSVSSIAQGLEWAGNNRMHVANLSLGLQAPSATLEQAVNSATSRGVLVVAASGNSGAGSISYPARYANAMAVGATDQNNNRASFSQYGDGLDIVAPGVNVLSTYPGSTYASLNGTSMATPHVAGAAALVKQKNPSWSNVQIRNHLKNTATSLGSTNLYGSGLVNAEAATR

SEQ ID NO: 47 - protein, 269 aa, artificial sequence
  GG36 ;protease variant
AQSVPWGISRVQAPAAHNRGLTGRGVKTAVLDTGISTHPDLSIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGEGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 48 - protein, 269 aa, artificial sequence
  GG36 ;protease variant
AQSVPWGISRVQAPAAHNRGLTGRGVKTAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGDGLDIVAPGVNVLSTYPGSTYASLNGTSMATPHVAGAAALVKQKNPSWSNVQIRNHLKNTATSLGSTNLYGSGLVNAEAATR

SEQ ID NO: 49 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSAYASLNGTSMATPHVAGAAALVKQKNPSWSNVQIRNHLKNTATSLGSTNLYGSGLVNAEAATR

SEQ ID NO: 50 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGDVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 51 - protein, 269 aa, artificial sequence
  GG36 ;protease variant
AQSVPWGISRVQAPAAHNRGLTGRGVKTAVLDTGISTHPDLNIRGGASFVPGEPSTQDGNGHGTHVAGTIAALDNNIGVLGVAPRAELYAVKVLGASGVGSVSSISQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSAYASKNGTSMATPHVAGAAALVKQKNPSWSNVQIRNHLKNTATSLGSTNLYGSGLVNAEAATR

SEQ ID NO: 52 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASKNGTSMATPHVAGAAALVKQKNPSWSNVQIRNHLKNTATSLGSTNLYGSGLVNAEAATR

SEQ ID NO: 53 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGPVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 54 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSSVQIRNHLKNTATSLGSTNLYGSGLVNAEAATR

SEQ ID NO: 55 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNRLKNTATSLGSTNLYGSGLVNAEAATR

SEQ ID NO: 56 - protein, 269 aa, artificial sequence
  GG36 ;protease variant
AQSVPWGISRVQAPAAHRRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 57 - protein, 269 aa, artificial sequence
  GG36 ;protease variant
AQSVPWGISRVQAPAAHRRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNRLKNTATSLGSTNLYGSGLVNAEAATR

SEQ ID NO: 58 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNNLKNTATSLGSTNLYGSGLVNAEAATR

SEQ ID NO: 59 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNNIGVLGVAPRAELYAVKVLGANGSGSVSSIAQGLEWAGNNRMHVANLSLGLQAPSATLEQAVNSATSRGVLVVAASGNSGTGSISYPARYANAMAVGATDQNNNRASFSQYGAGLDIVAPGVNVLSTYPGSTYASLNGTSMATPHVAGAAALVKQKNPSWSNVQVRNRLKNTATSLGSTNLYGSGLVNAEAATR

SEQ ID NO: 60 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVTQKNPSWSNVQIRNHLKNTATSLGSTNLYGSGLVNAEAATR

SEQ ID NO: 61 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNTEAATR

SEQ ID NO: 62 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNNIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNRLKNTATSLGSTNLYGSGLVNAEAATR

SEQ ID NO: 63 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNRLKNTATSLGSTNLYGSGLVNAEAATR

SEQ ID NO: 64 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNNIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNRLKNTATSLGSTNLYGSGLVNAEAATR

SEQ ID NO: 65 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNSIGVLGVAPRAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVYSTYPGSAYASLNGTSQATPHVAGAAALVKQKNPSWSNVQIRNRLKNTATSLGSTNLYGSGLVNAEAATR

SEQ ID NO: 66 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPDAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSQATPHVAGAAALVKQKNPSWSNVQIRNRLKNTATSLGSTNLYGSGLVNAEAATR

SEQ ID NO: 67 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALNNSIGVLGVAPDAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVLSTWPGSAYASLNGTSMATPHVAGAAALVKQKNPSWSNVQIRNRLKNTATSLGSTNLYGSGLVNAEAATR

SEQ ID NO: 68 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVLSTYPGSTYASLNGTSQATPHVAGAAALVKQKNPSWSNVQIRNHLKNTATSLGSTNLYGSGLVNAEAATR

SEQ ID NO: 69 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVLSTYPGSTYASLNGTSQATPHVAGAAALVKQKNPSWSNVQIRNHLKNTATSLGSTNLYGSGLVNAEAATR

SEQ ID NO: 70 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQSPSATLEQAVNSATSRGVLVVAASGNSGAGSISYPARYANAMAVGATDQNNNRASFSQYGAGLDIVAPGVNVLSTYPGSTYASLNGTSQATPHVAGAAALVKQKNPSWSNVQIRNHLKNTATSLGSTNLYGSGLVNAEAATR

SEQ ID NO: 71 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGSQSPSATLEQAVNSATSRGVLVVAASGNSGAGSISYPARYANAMAVGATDQNNNRASFSQYGAGLDIVAPGVNVLSTYPGSTYASLNGTSQATPHVAGAAALVKQKNPSWSNVQIRNHLKNTATSLGSTNLYGSGLVNAEAATR

SEQ ID NO: 72 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGSPAPSATLEQAVNSATSRGVLVVAASGNSGAGSISYPARYANAMAVGATDQNNNRASFSQYGAGLDIVAPGVNVLSTYPGSTYASLNGTSQATPHVAGAAALVKQKNPSWSNVQIRNHLKNTATSLGSTNLYGSGLVNAEAATR

SEQ ID NO: 73 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 74 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLPAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 75 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLPSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 76 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGSQSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 77 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGSPAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 78 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVLSTYPGSTYASLNGTSQATPHVAGAAALVKQKNPSWSNVQIRNHLKNTATSLGSTNLYGSGLVNAEAATR

SEQ ID NO: 79 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 80 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSQATPHVAGAAALVKQKNPSWSNVQIRNHLKNTATSLGSTNLYGSGLVNAEAATR

SEQ ID NO: 81 - protein, 269 aa, artificial sequence
  GG36 ;protease variant
AQSVPWGISRVQAPAAHNRGLTGRGVKVAVLDTGISTHPDLRIRGGASFVPGEPSTQDGNGHGTHVAGTIAALDNNIGVLGVAPRAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSQATPHVAGAAALVKQKNPSWSNVQIRNHLKNTATSLGSTNLYGSGLVNAEAATR

SEQ ID NO: 82 - protein, 269 aa, artificial sequence
  GG36 ;protease variant
AQSVPWGISRVQAPAAHNRRLTGRGVKVAVLDTGISTHPDLRIRGGASFVPGEPSTQDGNGHGTHVAGTIAALDNNIGVLGVAPRAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSQATPHVAGAAALVKQKNPSWSNVQIRNHLKNTATSLGSTNLYGSGLVNAEAATR

SEQ ID NO: 83 - protein, 269 aa, artificial sequence
  GG36 ;protease variant
AQSVPWGISRVQAPAAHNRRLTGSGVKVAVLDTGISTHPDLRIRGGASFVPGEPSTQDGNGHGTHVAGTIAALDNNIGVLGVAPRAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSQATPHVAGAAALVKQKNPSWSNVQIRNHLKNTATSLGSTNLYGSGLVNAEAATR

SEQ ID NO: 84 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVLSTWPGSAYASLNGTSQATPHVAGAAALVKQKNPSWSNVQIRNHLKNTATSLGSTNLYGSGLVNAEAATR

SEQ ID NO: 85 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVLSTYPGSAYASLNGTSQATPHVAGAAALVKQKNPSWSNVQIRNHLKNTATSLGSTNLYGSGLVNAEAATR

SEQ ID NO: 86 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSAYASLNGTSQATPHVAGAAALVKQKNPSWSNVQIRNHLKNTATSLGSTNLYGSGLVNAEAATR

SEQ ID NO: 87 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGLNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSQATPHVAGAAALVKQKNPSWSNVQIRNHLKNTATSLGSTNLYGSGLVNAEAATR

SEQ ID NO: 88 - protein, 269 aa, artificial sequence
  GG36 ;protease variant
AQSVPWGISRVQAPAAHNRRLTGRGVKVAVLDTGISTHPDLRIRGGASFVPGEPSTQDGNGHGTHVAGTIAALDNNIGVLGVAPRAELYAVKVLGASGSGSVSSIAQGLEWAGLNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSQATPHVAGAAALVKQKNPSWSNVQIRNHLKNTATSLGSTNLYGSGLVNAEAATR

SEQ ID NO: 89 - protein, 269 aa, artificial sequence
  GG36 ;protease variant
AQSVPWGISRVQAPAAHRRGLTGSGVKVAVLDTGISTHPDLNIRGGASFVPGEPSTQDGNGHGTHVAGTIAALDNSIGVLGVAPRAELYAVKVLGASGSGSVSSIAQGLEWAGNNGMHVANLSLGLQAPSATLEQAVNSATSRGVLVVAASGNSGAGSISYPARYANAMAVGATDQNNNRASFSQYGAGLDIVAPGVNVLSTWPGSTYASLNGTSMATPHVAGAAALVKQKNPSWSNVQIRNRLKNTATSLGSTNLYGSGLVNAEAATR

SEQ ID NO: 90 - protein, 269 aa, artificial sequence
  GG36 ;protease variant
AQSVPWGISRVQAPAAHRRGLTGSGVKVAVLDTGISTHPDLNIRGGASFVPGEPSTQDGNGHGTHVAGTIAALNNSIGVLGVAPDAELYAVKVLGASGSGSVSSIAQGLEWAGNNGMHVANLSLGSPSPSATLEQAVNSATSRGVLVVAASGNSGAGSINYPARYANAMAVGATDQNNNRASFSQYGAGLDIVAPGVNVLSTWPGSTYASLNGTSMATPHVAGAAALVKQKNPSWSNVQIRNHLKNTATSLGSTNLYGSGLVNAEAATR

SEQ ID NO: 91 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLTSPSPSATLEQAVNSATSRGVLVVAASGNSGAGSISYPARYANAMAVGATDQNNNRASFSQYGAGLDIVAPGVNVQSTWPGSAYASLNGTSMATPHVAGAAALVKQKNPSWSNVQIRNHLKNTATSLGSTNLYGSGLVNAEAATR

SEQ ID NO: 92 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSIDYPARYANAMAVGATDQNNNRASFSQYGAGLDIVAPGVNVYSTYPGSTYASLNGTSMATPHVAGAAALVKQKNPSWSNVQIRNRLKNTATSLGSTNLYGSGLVNAEAATR

SEQ ID NO: 93 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALNNNIGVLGVAPRAELYAVKVLGASGSGSVSSIAQGLEWAGNNGMHVANLSLGSPSPSATLEQAVNSATSRGVLVVAASGNSGAGSIDYPARYANAMAVGATDQNNNRASFSQYGAGLDIVAPGVNVLSTWPGSTYASLNGTSMATPHVAGAAALVKQKNPSWSNVQIRNRLKNTATSLGSTNLYGSGLVNAEAATR

SEQ ID NO: 94 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGGGAISSIAQGLEWAGNNRMHVANLSLGSPSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 95 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLTSPSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 96 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLTSQSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 97 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLTSQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 98 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGGGAISSIAQGLEWAGNNRMHVANLSLTSRSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 99 - protein, 269 aa, artificial sequence
  GG36 ;protease variant
AQVVPWGISRVQAPAAHNRGLTGRGVKVAVLDTGISTHPDLNIRGGASFVPGEPSTQDGNGHGTHVAGTIAALDNNIGVLGVAPDAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSQATPHVAGAAALVKQKNPSWSNVQIRNRLKNTATSLGSTNLYGSGLVNAEAATR

SEQ ID NO: 100 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPDAELYAVKVLGASGVGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSQATPHVAGAAALVKQKNPSWSNVQIRNRLKNTATSLGSTNLYGSGLVNAEAATR

SEQ ID NO: 101 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPDAELYAVKVLGASGGGAISSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSQATPHVAGAAALVKQKNPSWSNVQIRNRLKNTATSLGSTNLYGSGLVNAEAATR

SEQ ID NO: 102 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPDAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGDTYASLNGTSQATPHVAGAAALVKQKNPSWSNVQIRNRLKNTATSLGSTNLYGSGLVNAEAATR

SEQ ID NO: 103 - protein, 269 aa, artificial sequence
  GG36 ;protease variant
AQVVPWGISRVQAPAAHNRGLTGRGVKVAVLDTGISTHPDLNIRGGASFVPGEPSTQDGNGHGTHVAGTIAALDNNIGVLGVAPDAELYAVKVLGASGGGAISSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSQATPHVAGAAALVKQKNPSWSNVQIRNRLKNTATSLGSTNLYGSGLVNAEAATR

SEQ ID NO: 104 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPDAELYAVKVLGASGGGAISSIAQGLEWAGNNRMHVANLSLTSPSPSATLEQAVNSATSRGVLVVAASGNSGAGSISYPARYANAMAVGATDQNNNRASFSQYGAGLDIVAPGVNVQSTWPGSAYASLNGTSQATPHVAGAAALVKQKNPSWSNVQIRNRLKNTATSLGSTNLYGSGLVNAEAATR

SEQ ID NO: 105 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPDAELYAVKVLGASGGGAISSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSQATPHVAGAAVLVKQKNPSWSNVRIRNRLKNTATSLGSTNLYGSGLVNAEAATR

SEQ ID NO: 106 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPDAELYAVKVLGASGGGAISSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSMATPHVAGAAALVKQKNPSWSNVQIRNRLKNTATSLGSTNLYGSGLVNAEAATR

SEQ ID NO: 107 - protein, 269 aa, artificial sequence
  GG36 ;protease variant
AQVVPWGISRVQAPAAHNRGLTGRGVKVAVLDTGISTHPDLNIRGGASFVPGEPSTQDGNGHGTHVAGTIAALDNNIGVLGVAPDAELYAVKVLGASGGGAISSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSMATPHVAGAAALVKQKNPSWSNVQIRNRLKNTATSLGSTNLYGSGLVNAEAATR

SEQ ID NO: 108 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPDAELYAVKVLGASGGGAISSIAQGLEWAGNNRMHVANLSLTSPSPSATLEQAVNSATSRGVLVVAASGNSGAGSISYPARYANAMAVGATDQNNNRASFSQYGAGLDIVAPGVNVQSTWPGSAYASLNGTSMATPHVAGAAALVKQKNPSWSNVQIRNRLKNTATSLGSTNLYGSGLVNAEAATR

SEQ ID NO: 109 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPDAELYAVKVLGASGTGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSQATPHVAGAAALVKQKNPSWSNVQIRNRLKNTATSLGSTNLYGSGLVNAEAATR

SEQ ID NO: 110 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPDAELYAVKVLGASGHGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSQATPHVAGAAALVKQKNPSWSNVQIRNRLKNTATSLGSTNLYGSGLVNAEAATR

SEQ ID NO: 111 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPDAELYAVKVLGASGSGSVSSIAQGLEWAGNNRMHVANLSLGSQSPSATLEQAVNSATSRGVLVVAASGNSGAGSISYPARYANAMAVGATDQNNNRASFSQYGAGLDIVAPGVNVQSTWPGSTYASLNGTSQATPHVAGAAALVKQKNPSWSNVQIRNRLKNTATSLGSTNLYGSGLVNAEAATR

SEQ ID NO: 112 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPDAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 113 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPDAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSMATPHVAGAAALVKQKNPSWSNVQIRNRLKNTATSLGSTNLYGSGLVNAEAATR

SEQ ID NO: 114 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSQATPHVAGAAALVKQKNPSWSNVQIRNRLKNTATSLGSTNLYGSGLVNAEAATR

SEQ ID NO: 115 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNSIGVLGVAPRAELYAVKVLGASGSGSVSSIAQGLEWAGNNGMHVANLSLGLQAPSATLEQAVNSATSRGVLVVAASGNSGAGSISYPARYANAMAVGATDQNNNRASFSQYGAGLDIVAPGVNVLSTWPGSTYASLNGTSMATPHVAGAAALVKQKNPSWSNVQIRNRLKNTATSLGSTNLYGSGLVNAEAATR

SEQ ID NO: 116 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNSIGVLGVAPRAELYAVKVLGASGSGSVSSIAQGLEWAGNNGMHVANLSLGLQAPSATLEQAVNSATSRGVLVVAASGNSGAGSISYPARYANAMAVGATDQNNNRASFSQYGAGLDIVAPGVNVLSTWPGSTYASLNGTSMATPHVAGAAALVKQKNPSWSNVQIRNHLKNTATSLGSTNLYGSGLVNAEAATR

SEQ ID NO: 117 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPDAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSSATPHVAGAAALVKQKNPSWSNVQIRNRLKNTATSLGSTNLYGSGLVNAEAATR

SEQ ID NO: 118 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPDAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSMATPHVAGAAALVKQKNPSWSNVQIRNRLKNTATSLGSTNLYGSGLVNAEAATR

SEQ ID NO: 119 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPDAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSSATPHVAGAAALVKQKNPSWSNVQIRNRLKNTATSLGSTNLYGSGLVNAEAATR

SEQ ID NO: 120 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPDAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTYPGSTYASLNGTSQATPHVAGAAALVKQKNPSWSNVQIRNRLKNTATSLGSTNLYGSGLVNAEAATR

SEQ ID NO: 121 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPDAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSAYASLNGTSMATPHVAGAAALVKQKNPSWSNVQIRNHLKNTATSLGSTNLYGSGLVNAEAATR

SEQ ID NO: 122 - protein, 269 aa, artificial sequence
  GG36 ;protease variant
AQSVPWGISRVQAPAAHNRGLTGRGVKTAVLDTGISTHPDLNIRGGASFVPGEPSTQDGNGHGTHVAGTIAALDNNIGVLGVAPDAELYAVKVLGASGVGSVSSISQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 123 - protein, 269 aa, artificial sequence
  GG36 ;protease variant
AQSVPWGISRVQAPAAHNRGLTGRGVKTAVLDTGISTHPDLNIRGGASFVPGEPSTQDGNGHGTHVAGTIAALDNNIGVLGVAPDAELYAVKVLGASGVGSVSSIAQGLEWAGMNRMHVANLSLGLQAPSATLEQAVNSATSRGVLVVAASGNSGEGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 124 - protein, 269 aa, artificial sequence
  GG36 ;protease variant
AQVVPWGISRVQAPAAHNRGLTGRGVKVAVLDTGISTHPDLNIRGGASFVPGEPSTQDGNGHGTHVAGTIAALDNNIGVLGVAPRAELYAVKVLGASSVGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVLSTYPGSTYASKNGTSMATPHVAGAAALVKQKNPSWSNVQIRNHLKNTATSLGSTNLYGSGLVNAEAATR

SEQ ID NO: 125 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDDNIGVLGVAPRAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVLSTYPGSAYASLNGTSMATPHVAGAAALVKQKNPSWSNVQIRNHLKNTATSLGSTNLYGSGLVNAEAATR

SEQ ID NO: 126 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPDAELYAVKVLGASSVGSVSSIAQGLEWAGMNRMHVANMSLGLQAPSATLEQAVNSATSRGVLVVAASGNSGAGSISYPARYANAMAVGATDQNNNRASFSQYGDGLDIVAPGVNVLSTYPGSTYASLNGTSMATPHVAGAAALVKQKNPSWSNVQIRNHLKNTATSLGSTNLYGSGLVNAEAATR

SEQ ID NO: 127 - protein, 269 aa, artificial sequence
  GG36 ;protease variant
AQSVPWGISRVQAPAAHNRGLTGRGVKTAVLDTGISTHPDLNIRGGASFVPGEPSTQDGNGHGTHVAGTIAALDNNIGVLGVAPRAELYAVKVLGASGSGSVSSIAQGLEWAGNNVMHVANLSLGLQAPSATLEQAVNSATSRGVLVVAASGNSGAGSISYPARYANAMAVGATDQNNNRASFSQYGAGLDIVAPGVNVLSTYPGSAYASKNGTSMATPHVAGAAALVKQKNPSWSNVQIRNHLKNTATSLGSTNLYGSGLVNAEAATR

SEQ ID NO: 128 - protein, 269 aa, artificial sequence
  GG36 ;protease variant
AQSVPWGISRVQAPAAHRRGLTGSGVKVAVLDTGISTHPDLNIRGGASFVPGEPSTQDGNGHGTHVAGTIAALNNSIGVLGVAPRAELYAVKVLGASGSGSVSSIAQGLEWAGNNRMHVANLSLGSPSPSATLEQAVNSATSRGVLVVAASGNSGAGSINYPARYANAMAVGATDQNNNRASFSQYGAGLDIVAPGVDVLSTWPGSTYASLNGTSMATPHVAGAAALVKQKNPSWSNVQIRNHLKNTATSLGSTNLYGSGLVNAEAATR

SEQ ID NO: 129 - protein, 269 aa, artificial sequence
  GG36 ;protease variant
AQSVPWGISRVQAPAAHRRGLTGRGVKVAVLDTGISTHPDINIRGGASFVPGEPSTQDGNGHGTHVAGTIAALNNSIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSAYASLNGTSQATPHVAGAAALVKQKNPSWSNVQIRNRLKNTATSLGSTNLYGSGLVNAEAATR

SEQ ID NO: 130 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTWPGSAYASLNGTSMATPHVAGAAALVKQKNPSWSNVQIRNRLKNTATSLGSTNLYGSGLVNAEAATR

SEQ ID NO: 131 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALNNSIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTWPGSAYASLNGTSMATPHVAGAAALVKQKNPSWSNVQIRNRLKNTATSLGSTNLYGSGLVNAEAATR

SEQ ID NO: 132 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALNNSIGVLGVAPDAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSAYASLNGTSMATPHVAGAAALVKQKNPSWSNVQIRNRLKNTATSLGSTNLYGSGLVNAEAATR

SEQ ID NO: 133 - protein, 269 aa, artificial sequence
  GG36 ;protease variant
AQSVPWGIGRVQAPAAHRRGLTGRGVKVAVLDTGISTHPDLNIRGGASFVPGEPSTQDGNGHGTHVAGTIAALDNSIGVLGVAPSAELYAVKVLGASGSGSVSSIAQGLEWAGNNRMHVANLSLGSPSPSATLEQAVNSATSRGVLVVAASGNSGAGSINYPARYANAMAVGATDQNNNRASFSQYGAGLDIVAPGVNVLSTYPGSTYASLNGTSMATPHVAGAAALVKQKNPSWSNVQIRNRLKNTATSLGSTNLYGSGLVNAEAATR

SEQ ID NO: 134 - protein, 269 aa, artificial sequence
  GG36 ;protease variant
AQSVPWGISRVQAPAAHRRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVLSTWPGSAYASLNGTSQATPHVAGAAALVKQKNPSWSNVQIRNRLKNTATSLGSTNLYGSGLVNAEAATR

SEQ ID NO: 135 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALNNSIGVLGVAPRAELYAVKVLGASGSGSVSSIAQGLEWAGNNGMHVANLSLGSPSPSATLEQAVNSATSRGVLVVAASGNSGAGSINYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 136 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALNNSIGVLGVAPRAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVLSTWPGSAYASLNGTSMATPHVAGAAALVKQKNPSWSNVQIRNHLKNTATSLGSTNLYGSGLVNAEAATR

SEQ ID NO: 137 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALNNSIGVLGVAPSAELYAVKVLGASGSGSVSSIAQGLEWAGNNRMHVANLSLGSPSPSATLEQAVNSATSRGVLVVAASGNSGVGSISYPARYANAMAVGATDQNNNRASFSQYGAGLDIVAPGVNVQSTWPGSTYASLNGTSMATPHVAGAAALVKQKNPSWSNVQIRNHLKNTATSLGSTNLYGSGLVNAEAATR

SEQ ID NO: 138 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALNNSIGVLGVAPDAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVLSTWPGSTYASLNGTSQATPHVAGAAALVKQKNPSWSNVQIRNRLKNTATSLGSTNLYGSGLVNAEAATR

SEQ ID NO: 139 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALNNSIGVLGVAPRAELYAVKVLGASGSGSVSSIAQGLEWAGNNGMHVANLSLTSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 140 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSINYPARYANAMAVGATDQNNNRASFSQYGAGLDIVAPGVNVQSTWPGSAYASLNGTSMATPHVAGAAALVKQKNPSWSNVQIRNHLKNTATSLGSTNLYGSGLVNAEAATR

SEQ ID NO: 141 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSMATPHVAGAAALVKQKNPSWSNVQIRNRLKNTATSLGSTNLYGSGLVNAEAATR

SEQ ID NO: 142 - protein, 269 aa, artificial sequence
  GG36 ;protease variant
AQSVPWGISRVQAPAAHRRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVLSTWPGSTYASLNGTSMATPHVAGAAALVKQKNPSWSNVQIRNRLKNTATSLGGTNLYGSGLVNAEAATR

SEQ ID NO: 143 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALNNSIGVLGVAPDAELYAVKVLGASGSGSVSSIAQGLEWAGNNGMHVANLSLGSPSPSATLEQAVNSATSRGVLVVAASGNSGAGSISYPARYANAMAVGATDQNNYRASFSQYGAGLDIVAPGVNVLSTWPGSAYASLNGTSQATPHVAGAAALVKQKNPSWSNVQIRNRLKNTATSLGSTNLYGSGLVNAEAATR

SEQ ID NO: 144 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALNNSIGVLGVAPSAELYAVKVLGASGSGSVSSIAQGLEWAGNNRMHVANLSLTSPSPSATLEQAVNSATSRGVLVVAASGNSGAGSISYPARYANAMAVGATDQNNNRASFSQYGAGLDIVAPGVNVQSTWPGSTYASLNGTSMATPHVAGAAALVKQKNPSWSNVQIRNHLKNTATSLGSTNLYGSGLVNAEAATR

SEQ ID NO: 145 - protein, 269 aa, artificial sequence
  GG36 ;protease variant
VQSVPWGISRVQAPAAHRRGLTGRGVKVAVLDTGISTHPDLNIRGGASFVPGEPPTQDGNGHGTHVAGTIAALNNSIGVLGVAPSAELYAVKVLGASGSGSVSSIAQGLEWAGNNGMHVANLSLTSPSPSATLEQAVNSATSRGVLVVAASGNSGAGSISYPARYANAMAVGATDQNNNRASFSQYGAGLDIVAPGVNVLSTWPGSTYASLNGTSMATPHVAGAAALVKQKNPSWSNVQIRNHLKNTATSLGSTNLYGSGLVNAEAATR

SEQ ID NO: 146 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALNNSIGVLGVAPRAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTWPGSTYASLNGTSMATPHVAGAAALVKQKNPSWSNVQIRNHLKNTATSLGSTNLYGSGLVNAEAATR

SEQ ID NO: 147 - protein, 269 aa, artificial sequence
  GG36 ;protease variant
AQSVPWGISRVQAPAAHRRGLTGSGVKVAVLDTGISTHPDLNIRGGASFVPGEPSTQDGNGHGTHVAGTIAALNNSIGVLGVAPDAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTWPGSTYASLNGTSQATPHVAGAAALVKQKNPSWSNVQIRNRLKNTATSLGSTNLYGSGLVNAEAATR

SEQ ID NO: 148 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALNNSIGVLGVAPSAELYAVKVLGASGSGSVSSIAQGLEWAGNNRMHVANLSLGLQAPSATLEQAVNSATSRGVLVVAASGNSGAGSIDYPARYANAMAVGATDQNNNRASFSQYGAGLDIVAPGVNVQSTWPGSAYASLNGTSMATPHVAGAAALVKQKNPSWSNVQIRNHLKNTATSLGSTNLYGSGLVNAEAATR

SEQ ID NO: 149 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALNNSIGVLGVAPDAELYAVKVLGASGSGSVSSIAQGLEWAGNNGMHVANLSLGSPSPSATLEQAVNSATSRGVLVVAASGNSGAGSIDYPARYANAMAVGATDQNNNRASFSQYGAGLDIVAPGVNVQSTYPGSAYASLNGTSMATPHVAGAAALVKQKNPSWSNVQIRNRLKNTATSLGSTNLYGSGLVNAEAATR

SEQ ID NO: 150 - protein, 269 aa, artificial sequence
  GG36 ;protease variant
AQSVPWGISRVQAPAAHRRGLTGPGVKVAVLDTGISTHPDLNIRGGASFVPGEPSTQDGNGHGTHVAGTIAALNNSIGVLGVAPDAELYAVKVLGASGSGSVSSIAQGLEWAGNNGMHVANLSLGSPSPSATLEQAVNSATSRGVLVVAASGNSGAGSINYPARYANAMAVGATDQNNNRASFSQYGAGLDIVAPGVNVLSTWPGSTYASLNGTSQATPHVAGAAALVKQKNPSWSNVQIRNRLKNTATSLGSTNLYGSGLVNAEAATR

SEQ ID NO: 151 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNSIGVLGVAPSAELYAVKVLGASGSGSVSSIAQGLEWAGNNGMHVANLSLGSPSPSATLEQAVNSATSRGVLVVAASGNSGAGSINYPARYANAMAVGATDQNNNRASFSQYGAGLDIVAPGVNVQSTWPGSAYASLNGTSMATPHVAGAAALVKQKNPSWSNVQIRNRLKNTATSLGSTNLYGSGLVNAEAATR

SEQ ID NO: 152 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVLSTWPGSAYASLNGTSQATPHVAGAAALVKQKNPSWSNVQIRNRLKNTATSLGSTNLYGSGLVNAEAATR

SEQ ID NO: 153 - protein, 269 aa, artificial sequence
  GG36 ;protease variant
AQSVPWGISRVQAPAAHRRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVLSTWPGSTYASLNGTSMATPHVAGAAALVKQKNPSWSNVQIRNHLKNTATSLGSTNLYGSGLVNAEAATR

SEQ ID NO: 154 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSIDYPARYANAMAVGATDQNNNRASFSQYGAGLDIVAPGVNVYSTYPGSTYASLNGTSMATPHVAGAAALVKQKNPSWSNVQIRNRLKNTTTSLGSTNLYGSGLVNAEAATR

SEQ ID NO: 155 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALNNNIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVLSTWPGSAYASLNGTSQATPHVAGAAALVKQKNPSWSNVQIRNRLKNTATSLGSTNLYGSGLVNAEAATR

SEQ ID NO: 156 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALNNSIGVLGVAPSAELYAVKVLGASGSGSVSSIAQGLEWAGNNRMHVANLSLTSPSPSATLEQAVNSATSRGVLVVAASGNSGAGSISYPARYANAMAVGATDQNNNRASFSQYGAGLDIVAPGVNVQSTWPGSTYASLNGTSMATPHVAGAAALVKQKNPSWSNVQIRNHLKNTATSLGSTNLYGSGLVNAEAATR

SEQ ID NO: 157 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNSIGVLGVAPSAELYAVKVLGASGSGSVSSIAQGLEWAGNNRMHVANLSLGSPSPSATLEQAVNSATSRGVLVVAASGNSGAGSINYPARYANAMAVGATDQNNNRASFSQYGAGLDIVAPGVNVLSTWPGSTYASLNGTSMATPHVAGAAALVKQKNPSWSNVQIRNHLKNTATSLGSTNLYGSGLVNAEAATR

SEQ ID NO: 158 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNSIGVLGVAPRAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTWPGSAYASLNGTSQATPHVAGAAALVKQKNPSWSNVQIRNRLKNTATSLGSTNLYGSGLVNAEAATR

SEQ ID NO: 159 - protein, 269 aa, artificial sequence
  GG36 ;protease variant
AQSVPWGISRVQAPAAHKRGLTGSGVKVAVLDTGISTHPDLNIRGGASFVPGEPSTQDGNGHGTHVAGTIAALNNSIGVLGVAPRAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTWPGSAYASLNGTSQATPHVAGAAALVKQKNPSWSNVQIRNRLKNTATSLGSTNLYGSGLVNAEAATR

SEQ ID NO: 160 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALNNSIGVLGVAPRAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTWPGSTYASLNGTSMATPHVAGAAALVKQKNPSWSNVQIRNHLKNTATSLGSTNLYGSGLVNAEAATR

SEQ ID NO: 161 - protein, 269 aa, artificial sequence
  GG36 ;protease variant
AQSVPWGISRVQAPAAHRRGLTGSGVKVAVLDTGISTHPDLNIRGGASFVPGEPSTQDGNGHGTHVAGTIAALNNNIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSAYASLNGTSQATPHVAGAAALVKQKNPSWSNVQIRNRLKNTATSLGSTNLYGSGLVNPEAATR

SEQ ID NO: 162 - protein, 269 aa, artificial sequence
  GG36 ;protease variant
AQSVPWGISRVQAPAAHRRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSINYPARYANAMAVGATDQNNNRASFSQYGAGLDIVAPGVNVQSTWPGSAYASLNGTSQATPHVAGAAALVKQKNPSWSNVQIRNHLKNTATSLGSTNLYGSGLVNAEAATR

SEQ ID NO: 163 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPSAELYAVKVLGASGSGSVSSIAQGLEWAGNNGMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNRLKNTATSLGSTNLYGSGLVNAEAATR

SEQ ID NO: 164 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNNIGVLGVAPSAELYAVKVLGASGSGSVSSIAQGLEWAGNNGMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNRLKNTATSLGSTNLYGSGLVNAEAATR

SEQ ID NO: 165 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNRLKNTATSLGSTNLYGSGLVNAEAATR

SEQ ID NO: 166 - protein, 269 aa, artificial sequence
  GG36 ;protease variant
AQSVPWGISRVQAPAAHRRGLTGSGVKVAVLDTGISTHPDLNVRGGASFVPGEPSTQDGNGHGTHVAGTIAALDNNIGVLGVAPRAELYAVKVLGASGSGSVSSIAQGLEWAGNNGMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNRLKNTATSLGSTNLYGSGLVNAEAATR

SEQ ID NO: 167 - protein, 269 aa, artificial sequence
  GG36 ;protease variant
AQSVPWGISRVQAPAAHRRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNRLKNTATSLGSTNLYGSGLVNAEAATR

SEQ ID NO: 168 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNGMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 169 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 170 - protein, 269 aa, artificial sequence
  GG36 ;protease variant
AQSVPWGISRVQAPATHRRGLTGRGVKVAVLDTGISTHPDLNIRGGASFVPGEPSTQDGNGHGTHVAGTIAALDNNIGVLGVAPSAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 171 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTWPGSTYASLNGTSMATPHVAGAAALVKQKNPSWSNVQIRNHLKNTATSLGSTNLYGSGLVNAEAATR

SEQ ID NO: 172 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNRLKNTATSLGSTNLYGSGLVNAEAATR

SEQ ID NO: 173 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNGMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 174 - protein, 269 aa, artificial sequence
  GG36 ;protease variant
AQSVPWGISRVQAPAAHRRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNGMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 175 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNNIGVLGVAPSAELYAVKVLGASGSGSVSSIAQGLEWAGNNGMHVANLSLGLQAPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 176 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNRLKNTATSLGSTNLYGSGLVNAEAATR

SEQ ID NO: 177 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNNIGVLGVAPSAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNRLKNTATSLGSTNLYGSGLVNAEAATR

SEQ ID NO: 178 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNNIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSQATPHVAGAAALVKQKNPSWSNVQIRNRLKNTATSLGSTNLYGSGLVNAEAATR

SEQ ID NO: 179 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNRLKNTATSLGSTNLYGSGLVNAEAATR

SEQ ID NO: 180 - protein, 269 aa, artificial sequence
  GG36 ;protease variant
AQSVPWGISRVQAPAAHRRGLTGSGVKVAVLDTGISTHPDLNIRGGASFVPGEPSTQDGNGHGTHVAGTIAALDNNIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNRLKNTATSLGSTNLYGSGLVNAEAATR

SEQ ID NO: 181 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNNIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLRNTATSLGSTNLYGSGLVNAEAATR

SEQ ID NO: 182 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNRLKNTATSLGSTNLYGSGLVNAEAATR

SEQ ID NO: 183 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNNIGVLGVAPRAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 184 - protein, 269 aa, artificial sequence
  GG36 ;protease variant
AQSVPWGISRVQAPAAHRRGLTGRGVKVAVLDTGISTHPDLNIRGGASFVPGEPSTQDGNGHGTHVAGTIAALDNNIGVLGVAPSAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 185 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPSAELYAVKVLGASGSGSVSSIAQGLEWAGNNGMRVANLSLGSPSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNRLKNTATSLGSTNLYGSGLVNAEAATR

SEQ ID NO: 186 - protein, 269 aa, artificial sequence
  GG36 ;protease variant
AQSVPWGISRVQAPAAHRRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNGMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNRLKNTATSLGSTNLYGSGLVNAEAATR

SEQ ID NO: 187 - protein, 269 aa, artificial sequence
  GG36 ;protease variant
AQSVPWGISRVQAPAAHRRELTGSGVKVAVLDTGISTHPDLNIRGGASFVPGEPSTQDGNGHGTHVAGTIAALDNNIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNRLKNTATSLGSTNLYGSGLVNAEAATR

SEQ ID NO: 188 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPSAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 189 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPSAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNRLKNTATSLGSTNLYGSGLVNAEAATR

SEQ ID NO: 190 - protein, 269 aa, artificial sequence
  GG36 ;protease variant
AQSVPWGISRVQAPAAHNRGLTGRGVKVAVLDTGISTHPDLNIRGGASFVPGEPSTQDGNGHGTHVAGTIAALDNNIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLVNAEAATR

SEQ ID NO: 191 - protein, 269 aa, artificial sequence
  GG36 ;protease variant
AQSVPWGISRVQAPAAHRRGLTGSGVKVAVLDTGISTHPDLNIRGGASFVPGEPSTQDGNGHGTHVAGTIAALDNNIGVLGVAPSAELYAVKVLGASGSGSVSSIAQGLEWAGNNGMHVANLSLGLQAPSATLEQAVNSATSRGVLVVAASGNSGAGSISYPARYANAMAVGATDQNNNRASFSQYGAGLDIVAPGVNVLSTYPGSTYASLNGTSMATPHVAGAAALVKQKNPSWSNVQIRNHLKNTATSLGSTNLYGSGLANAEAATR

SEQ ID NO: 192 - protein, 269 aa, artificial sequence
  GG36 ;protease variant
AQSVPWGISRVQAPAAHRRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVLSTYPGSTYASLSGTSQATPHVAGAAALVKQKNPSWSNVQIRNRLKNTATSLGSTNLYGSGLVNAEAATR

SEQ ID NO: 193 - protein, 269 aa, artificial sequence
  GG36 ;protease variant
AQSVPWGISRVQAPAAHNRGLTGFGVKVAVLDTGISTHPDLNIRGGASFVPGEPSTQDGNGHGTHVAGTIAALNNNIGVLGVAPSAELYAVKVLGASGSGSVSSIAQGLEWAGNNRMHVANLSLGSPSPSATLEQAVNSATSRGVLVVAASGNSGAGSIDYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 194 - protein, 269 aa, artificial sequence
  GG36 ;protease variant
AQSVPWGISRVQAPAAHNRGLLGFGVKVAVLDTGISTHPDLNIRGGASFVPGEPSTQDGNGHGTHVAGTIAALNNNIGVLGVAPSAELYAVKVLGASGSGSVSSIAQGLEWAGNNRMHVANLSLGSPSPSATLEQAVNSATSRGVLVVAASGNSGAGSIDYPARYANAMAVGATDQNNNRASFSQYGAGLDIVAPGVNVQSTYPGSAYASLNGTSMATPHVAGAAALVKQKNPSWSNVQIRNHLKNTATSLGSTNLYGSGLVNAEAATR

SEQ ID NO: 195 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNGIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVFSTYPGSTYASLNGTSMATPHVAGAAALVKQKNPSWSNVQIRNHLKNTATSLGSTNLYGSGLVNAEAATR

SEQ ID NO: 196 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNGIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNLYGSGLVNAEAATR

SEQ ID NO: 197 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNGIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVFSTYPGSTYASLNGTSMATPHVAGAAALVKQKNPSWSNVQIRNHLKNTATSLGSTNLYGSGLVNAEAATR

SEQ ID NO: 198 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNGIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVMSTYPGSTYASLNGTSMATPHVAGAAALVKQKNPSWSNVQIRNHLKNTATSLGSTNLYGSGLVNAEAATR

SEQ ID NO: 199 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNGIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNLYGSGLVNAEAATR

SEQ ID NO: 200 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVFSTYPGSTYASLNGTSMATPHVAGAAALVKQKNPSWSNVQIRNHLKNTATSLGSTNLYGSGLVNAEAATR

SEQ ID NO: 201 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVMSTYPGSTYASLNGTSMATPHVAGAAALVKQKNPSWSNVQIRNHLKNTATSLGSTNLYGSGLVNAEAATR

SEQ ID NO: 202 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNLYGSGLVNAEAATR

SEQ ID NO: 203 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVFSTYPGSTYASLNGTSMATPHVAGAAALVKQKNPSWSNVQIRNHLKNTATSLGSTNLYGSGLVNAEAATR

SEQ ID NO: 204 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVMSTYPGSTYASLNGTSMATPHVAGAAALVKQKNPSWSNVQIRNHLKNTATSLGSTNLYGSGLVNAEAATR

SEQ ID NO: 205 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNLYGSGLVNAEAATR

SEQ ID NO: 206 - protein, 269 aa, artificial sequence
  GG36 ;protease variant
AQSVPWGISRVQAPAAHNRGLTGSGVKVAVLDTGISTHEDLNIRGGASFVPGEPSTQDGNGHGTHVAGTIAALDNSIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 207 - protein, 269 aa, artificial sequence
  GG36 ;protease variant
AQSVPWGVSRVQAPAAHNRGLTGSGVKVAVLDTGISTHEDLNIRGGASFVPGEPSTQDGNGHGTHVAGTIAALDNSIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 208 - protein, 269 aa, artificial sequence
  GG36 ;protease variant
AQSVPWGISRVQAPAAHNRGLTGSGVKVAVLDTGISTHEDLNIRGGASFVPGEPSTQDGNGHGTHVAGTIAALDNSIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYIGSTYASLNGTSMATPHVAGAAALVKQKNPSWSNVQIRNHLKNTATSLGSTNLYGSGLVNAEAATR

SEQ ID NO: 209 - protein, 269 aa, artificial sequence
  GG36 ;protease variant
AQSVPWGISRVQAPAAHNRGLTGSGVKVAVLDTGISTHEDLNIRGGASFVPGEPSTQDGNGHGTHVAGTIAALDNSIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYPPSTYASLNGTSMATPHVAGAAALVKQKNPSWSNVQIRNHLKNTATSLGSTNLYGSGLVNAEAATR

SEQ ID NO: 210 - protein, 269 aa, artificial sequence
  GG36 ;protease variant
AQSVPWGISRVQAPAAHNRGLTGSGVKVAVLDTGISTHEDLNIRGGASFVPGEPSTQDGNGHGTHVAGTIAALDNSIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTILYGSGLVNAEAATR

SEQ ID NO: 211 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYIGSTYASLNGTSMATPHVAGAAALVKQKNPSWSNVQIRNHLKNTATSLGSTNLYGSGLVNAEAATR

SEQ ID NO: 212 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTWPGSTYASLNGTSMATPHVAGAAALVKQKNPSWSNVQIRNHLKNTATSLGSTNQYGSGLVNAEAATR

SEQ ID NO: 213 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYIGSTYASLNGTSMATPHVAGAAALVKQKNPSWSNVQIRNHLKNTATSLGSTNQYGSGLVNAEAATR

SEQ ID NO: 214 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGILVVAASGNSGAGSISYPARYANAMAVGATDQNNNRASFSQYGPGLDIVAPGVNVQSTYPGSTYVSLNGTSMATPHVAGAAALVKQKNPSWSNVQIRNHLKNTATSLGSTNLYGSGLVNADAATR

SEQ ID NO: 215 - protein, 269 aa, artificial sequence
  GG36 ;protease variant
AQSVPWGISRVQAPAAHNRGLWGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGILVVAASGNSGAGSISYPARYANAMAVGATDQNNNRASFSQYGPGLDIVAPGVNVQSTYPGSTYVSLNGTSMATPHVAGAAALVKQKNPSWSNVQIRNHLKNTATSLGSTNLYGSGLVNAEAATR

SEQ ID NO: 216 - protein, 269 aa, artificial sequence
  GG36 ;protease variant
AQSVPWGISRVQAPAAHNRGLWGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGILVVAASGNSGAGSISYPARYANAMAVGATDQNNNRASFSQYGAGLDIVAPGVNVQSTYPGSTYVSLNGTSMATPHVAGAAALVKQKNPSWSNVQIRNHLKNTATSLGSTNLYGSGLVNADAATR

SEQ ID NO: 217 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNSIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYPGSTYASKNGTSMATPHVAGAAALVKQKNPSWSNVQIRNHLKNTATSLGSTNLYGSGLVNAEAATR

SEQ ID NO: 218 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYPGSTYASKNGTSMATPHVAGAAALVKQKNPSWSNVQIRNHLKNTATSLGSTNLYGSGLVNAEAATR

SEQ ID NO: 219 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGLQAPSATLEQAVNSATSRGVLVTAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 220 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNGIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYLGSTYASLNGTSMATPHVAGAAALVKQKNPSWSNVQIRNHLKNTATSLGSTNLYGSGLVNAEAATR

SEQ ID NO: 221 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNSIGVLGVAPRAHLYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNLYGSGLVNAEAATR

SEQ ID NO: 222 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNSIGVLGVAPRAHLYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYLGSTYASLNGTSMATPHVAGAAALVKQKNPSWSNVQIRNHLKNTATSLGSTNLYGSGLVNAEAATR

SEQ ID NO: 223 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNQIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVDSTYPGSTYASLNGTSMATPHVAGAAALVKQKNPSWSNVQIRNHLKNTATSLGSTNLYGSGLVNAEAATR

SEQ ID NO: 224 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNTIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVDSTYPGSTYASLNGTSMATPHVAGAAALVKQKNPSWSNVQIRNHLKNTATSLGSTNLYGSGLVNAEAATR

SEQ ID NO: 225 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNVIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVDSTYPGSTYASLNGTSMATPHVAGAAALVKQKNPSWSNVQIRNHLKNTATSLGSTNLYGSGLVNAEAATR

SEQ ID NO: 226 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNWIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVDSTYPGSTYASLNGTSMATPHVAGAAALVKQKNPSWSNVQIRNHLKNTATSLGSTNLYGSGLVNAEAATR

SEQ ID NO: 227 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNYIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVNSTYPGSTYASLNGTSMATPHVAGAAALVKQKNPSWSNVQIRNHLKNTATSLGSTNLYGSGLVNAEAATR

SEQ ID NO: 228 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNAIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVFSTYPGSTYASLNGTSMATPHVAGAAALVKQKNPSWSNVQIRNHLKNTATSLGSTNLYGSGLVNAEAATR

SEQ ID NO: 229 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNCIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVFSTYPGSTYASLNGTSMATPHVAGAAALVKQKNPSWSNVQIRNHLKNTATSLGSTNLYGSGLVNAEAATR

SEQ ID NO: 230 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNEIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVFSTYPGSTYASLNGTSMATPHVAGAAALVKQKNPSWSNVQIRNHLKNTATSLGSTNLYGSGLVNAEAATR

SEQ ID NO: 231 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNFIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVFSTYPGSTYASLNGTSMATPHVAGAAALVKQKNPSWSNVQIRNHLKNTATSLGSTNLYGSGLVNAEAATR

SEQ ID NO: 232 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNHIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVFSTYPGSTYASLNGTSMATPHVAGAAALVKQKNPSWSNVQIRNHLKNTATSLGSTNLYGSGLVNAEAATR

SEQ ID NO: 233 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNKIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVFSTYPGSTYASLNGTSMATPHVAGAAALVKQKNPSWSNVQIRNHLKNTATSLGSTNLYGSGLVNAEAATR

SEQ ID NO: 234 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNLIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVFSTYPGSTYASLNGTSMATPHVAGAAALVKQKNPSWSNVQIRNHLKNTATSLGSTNLYGSGLVNAEAATR

SEQ ID NO: 235 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNMIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVFSTYPGSTYASLNGTSMATPHVAGAAALVKQKNPSWSNVQIRNHLKNTATSLGSTNLYGSGLVNAEAATR

SEQ ID NO: 236 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNQIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVFSTYPGSTYASLNGTSMATPHVAGAAALVKQKNPSWSNVQIRNHLKNTATSLGSTNLYGSGLVNAEAATR

SEQ ID NO: 237 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNTIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVFSTYPGSTYASLNGTSMATPHVAGAAALVKQKNPSWSNVQIRNHLKNTATSLGSTNLYGSGLVNAEAATR

SEQ ID NO: 238 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNWIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVFSTYPGSTYASLNGTSMATPHVAGAAALVKQKNPSWSNVQIRNHLKNTATSLGSTNLYGSGLVNAEAATR

SEQ ID NO: 239 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNYIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVFSTYPGSTYASLNGTSMATPHVAGAAALVKQKNPSWSNVQIRNHLKNTATSLGSTNLYGSGLVNAEAATR

SEQ ID NO: 240 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNCIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVGSTYPGSTYASLNGTSMATPHVAGAAALVKQKNPSWSNVQIRNHLKNTATSLGSTNLYGSGLVNAEAATR

SEQ ID NO: 241 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNMIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVGSTYPGSTYASLNGTSMATPHVAGAAALVKQKNPSWSNVQIRNHLKNTATSLGSTNLYGSGLVNAEAATR

SEQ ID NO: 242 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNCIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVHSTYPGSTYASLNGTSMATPHVAGAAALVKQKNPSWSNVQIRNHLKNTATSLGSTNLYGSGLVNAEAATR

SEQ ID NO: 243 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNEIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVHSTYPGSTYASLNGTSMATPHVAGAAALVKQKNPSWSNVQIRNHLKNTATSLGSTNLYGSGLVNAEAATR

SEQ ID NO: 244 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNFIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVHSTYPGSTYASLNGTSMATPHVAGAAALVKQKNPSWSNVQIRNHLKNTATSLGSTNLYGSGLVNAEAATR

SEQ ID NO: 245 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNGIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVHSTYPGSTYASLNGTSMATPHVAGAAALVKQKNPSWSNVQIRNHLKNTATSLGSTNLYGSGLVNAEAATR

SEQ ID NO: 246 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNHIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVHSTYPGSTYASLNGTSMATPHVAGAAALVKQKNPSWSNVQIRNHLKNTATSLGSTNLYGSGLVNAEAATR

SEQ ID NO: 247 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNLIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVHSTYPGSTYASLNGTSMATPHVAGAAALVKQKNPSWSNVQIRNHLKNTATSLGSTNLYGSGLVNAEAATR

SEQ ID NO: 248 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNTIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVHSTYPGSTYASLNGTSMATPHVAGAAALVKQKNPSWSNVQIRNHLKNTATSLGSTNLYGSGLVNAEAATR

SEQ ID NO: 249 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNVIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVHSTYPGSTYASLNGTSMATPHVAGAAALVKQKNPSWSNVQIRNHLKNTATSLGSTNLYGSGLVNAEAATR

SEQ ID NO: 250 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNAIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVMSTYPGSTYASLNGTSMATPHVAGAAALVKQKNPSWSNVQIRNHLKNTATSLGSTNLYGSGLVNAEAATR

SEQ ID NO: 251 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNCIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVMSTYPGSTYASLNGTSMATPHVAGAAALVKQKNPSWSNVQIRNHLKNTATSLGSTNLYGSGLVNAEAATR

SEQ ID NO: 252 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNEIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVMSTYPGSTYASLNGTSMATPHVAGAAALVKQKNPSWSNVQIRNHLKNTATSLGSTNLYGSGLVNAEAATR

SEQ ID NO: 253 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNFIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVMSTYPGSTYASLNGTSMATPHVAGAAALVKQKNPSWSNVQIRNHLKNTATSLGSTNLYGSGLVNAEAATR

SEQ ID NO: 254 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNGIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVMSTYPGSTYASLNGTSMATPHVAGAAALVKQKNPSWSNVQIRNHLKNTATSLGSTNLYGSGLVNAEAATR

SEQ ID NO: 255 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNIIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVMSTYPGSTYASLNGTSMATPHVAGAAALVKQKNPSWSNVQIRNHLKNTATSLGSTNLYGSGLVNAEAATR

SEQ ID NO: 256 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNKIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVMSTYPGSTYASLNGTSMATPHVAGAAALVKQKNPSWSNVQIRNHLKNTATSLGSTNLYGSGLVNAEAATR

SEQ ID NO: 257 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNLIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVMSTYPGSTYASLNGTSMATPHVAGAAALVKQKNPSWSNVQIRNHLKNTATSLGSTNLYGSGLVNAEAATR

SEQ ID NO: 258 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNMIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVMSTYPGSTYASLNGTSMATPHVAGAAALVKQKNPSWSNVQIRNHLKNTATSLGSTNLYGSGLVNAEAATR

SEQ ID NO: 259 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNQIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVMSTYPGSTYASLNGTSMATPHVAGAAALVKQKNPSWSNVQIRNHLKNTATSLGSTNLYGSGLVNAEAATR

SEQ ID NO: 260 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNRIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVMSTYPGSTYASLNGTSMATPHVAGAAALVKQKNPSWSNVQIRNHLKNTATSLGSTNLYGSGLVNAEAATR

SEQ ID NO: 261 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNTIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVMSTYPGSTYASLNGTSMATPHVAGAAALVKQKNPSWSNVQIRNHLKNTATSLGSTNLYGSGLVNAEAATR

SEQ ID NO: 262 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNVIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVMSTYPGSTYASLNGTSMATPHVAGAAALVKQKNPSWSNVQIRNHLKNTATSLGSTNLYGSGLVNAEAATR

SEQ ID NO: 263 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNYIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVMSTYPGSTYASLNGTSMATPHVAGAAALVKQKNPSWSNVQIRNHLKNTATSLGSTNLYGSGLVNAEAATR

SEQ ID NO: 264 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNAIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVNSTYPGSTYASLNGTSMATPHVAGAAALVKQKNPSWSNVQIRNHLKNTATSLGSTNLYGSGLVNAEAATR

SEQ ID NO: 265 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNCIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVNSTYPGSTYASLNGTSMATPHVAGAAALVKQKNPSWSNVQIRNHLKNTATSLGSTNLYGSGLVNAEAATR

SEQ ID NO: 266 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNEIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVNSTYPGSTYASLNGTSMATPHVAGAAALVKQKNPSWSNVQIRNHLKNTATSLGSTNLYGSGLVNAEAATR

SEQ ID NO: 267 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNGIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVNSTYPGSTYASLNGTSMATPHVAGAAALVKQKNPSWSNVQIRNHLKNTATSLGSTNLYGSGLVNAEAATR

SEQ ID NO: 268 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNHIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVNSTYPGSTYASLNGTSMATPHVAGAAALVKQKNPSWSNVQIRNHLKNTATSLGSTNLYGSGLVNAEAATR

SEQ ID NO: 269 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNIIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVNSTYPGSTYASLNGTSMATPHVAGAAALVKQKNPSWSNVQIRNHLKNTATSLGSTNLYGSGLVNAEAATR

SEQ ID NO: 270 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNLIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVNSTYPGSTYASLNGTSMATPHVAGAAALVKQKNPSWSNVQIRNHLKNTATSLGSTNLYGSGLVNAEAATR

SEQ ID NO: 271 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNMIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVNSTYPGSTYASLNGTSMATPHVAGAAALVKQKNPSWSNVQIRNHLKNTATSLGSTNLYGSGLVNAEAATR

SEQ ID NO: 272 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNQIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVNSTYPGSTYASLNGTSMATPHVAGAAALVKQKNPSWSNVQIRNHLKNTATSLGSTNLYGSGLVNAEAATR

SEQ ID NO: 273 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNRIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVPSTYPGSTYASLNGTSMATPHVAGAAALVKQKNPSWSNVQIRNHLKNTATSLGSTNLYGSGLVNAEAATR

SEQ ID NO: 274 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNWIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVPSTYPGSTYASLNGTSMATPHVAGAAALVKQKNPSWSNVQIRNHLKNTATSLGSTNLYGSGLVNAEAATR

SEQ ID NO: 275 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNAIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVRSTYPGSTYASLNGTSMATPHVAGAAALVKQKNPSWSNVQIRNHLKNTATSLGSTNLYGSGLVNAEAATR

SEQ ID NO: 276 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNCIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVRSTYPGSTYASLNGTSMATPHVAGAAALVKQKNPSWSNVQIRNHLKNTATSLGSTNLYGSGLVNAEAATR

SEQ ID NO: 277 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNEIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVRSTYPGSTYASLNGTSMATPHVAGAAALVKQKNPSWSNVQIRNHLKNTATSLGSTNLYGSGLVNAEAATR

SEQ ID NO: 278 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNFIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVRSTYPGSTYASLNGTSMATPHVAGAAALVKQKNPSWSNVQIRNHLKNTATSLGSTNLYGSGLVNAEAATR

SEQ ID NO: 279 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNGIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVRSTYPGSTYASLNGTSMATPHVAGAAALVKQKNPSWSNVQIRNHLKNTATSLGSTNLYGSGLVNAEAATR

SEQ ID NO: 280 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNHIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVRSTYPGSTYASLNGTSMATPHVAGAAALVKQKNPSWSNVQIRNHLKNTATSLGSTNLYGSGLVNAEAATR

SEQ ID NO: 281 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNIIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVRSTYPGSTYASLNGTSMATPHVAGAAALVKQKNPSWSNVQIRNHLKNTATSLGSTNLYGSGLVNAEAATR

SEQ ID NO: 282 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNLIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVRSTYPGSTYASLNGTSMATPHVAGAAALVKQKNPSWSNVQIRNHLKNTATSLGSTNLYGSGLVNAEAATR

SEQ ID NO: 283 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNMIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVRSTYPGSTYASLNGTSMATPHVAGAAALVKQKNPSWSNVQIRNHLKNTATSLGSTNLYGSGLVNAEAATR

SEQ ID NO: 284 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNPIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVRSTYPGSTYASLNGTSMATPHVAGAAALVKQKNPSWSNVQIRNHLKNTATSLGSTNLYGSGLVNAEAATR

SEQ ID NO: 285 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNQIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVRSTYPGSTYASLNGTSMATPHVAGAAALVKQKNPSWSNVQIRNHLKNTATSLGSTNLYGSGLVNAEAATR

SEQ ID NO: 286 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNRIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVRSTYPGSTYASLNGTSMATPHVAGAAALVKQKNPSWSNVQIRNHLKNTATSLGSTNLYGSGLVNAEAATR

SEQ ID NO: 287 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNTIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVRSTYPGSTYASLNGTSMATPHVAGAAALVKQKNPSWSNVQIRNHLKNTATSLGSTNLYGSGLVNAEAATR

SEQ ID NO: 288 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNVIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVRSTYPGSTYASLNGTSMATPHVAGAAALVKQKNPSWSNVQIRNHLKNTATSLGSTNLYGSGLVNAEAATR

SEQ ID NO: 289 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNCIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVSSTYPGSTYASLNGTSMATPHVAGAAALVKQKNPSWSNVQIRNHLKNTATSLGSTNLYGSGLVNAEAATR

SEQ ID NO: 290 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNEIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVSSTYPGSTYASLNGTSMATPHVAGAAALVKQKNPSWSNVQIRNHLKNTATSLGSTNLYGSGLVNAEAATR

SEQ ID NO: 291 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNHIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVSSTYPGSTYASLNGTSMATPHVAGAAALVKQKNPSWSNVQIRNHLKNTATSLGSTNLYGSGLVNAEAATR

SEQ ID NO: 292 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNMIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVSSTYPGSTYASLNGTSMATPHVAGAAALVKQKNPSWSNVQIRNHLKNTATSLGSTNLYGSGLVNAEAATR

SEQ ID NO: 293 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNWIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVSSTYPGSTYASLNGTSMATPHVAGAAALVKQKNPSWSNVQIRNHLKNTATSLGSTNLYGSGLVNAEAATR

SEQ ID NO: 294 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNCIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNLYGSGLVNAEAATR

SEQ ID NO: 295 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNEIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNLYGSGLVNAEAATR

SEQ ID NO: 296 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNHIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNLYGSGLVNAEAATR

SEQ ID NO: 297 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNIIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNLYGSGLVNAEAATR

SEQ ID NO: 298 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNKIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNLYGSGLVNAEAATR

SEQ ID NO: 299 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNLIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNLYGSGLVNAEAATR

SEQ ID NO: 300 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNMIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNLYGSGLVNAEAATR

SEQ ID NO: 301 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNQIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNLYGSGLVNAEAATR

SEQ ID NO: 302 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNRIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNLYGSGLVNAEAATR

SEQ ID NO: 303 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNTIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNLYGSGLVNAEAATR

SEQ ID NO: 304 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNWIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNLYGSGLVNAEAATR

SEQ ID NO: 305 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNYIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNLYGSGLVNAEAATR

SEQ ID NO: 306 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNHIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVASTYPGSTYASLNGTSMATPHVAGAAALVKQKNPSWSNVQIRNHLKNTATSLGSTNLYGSGLVNAEAATR

SEQ ID NO: 307 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNHIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVDSTYPGSTYASLNGTSMATPHVAGAAALVKQKNPSWSNVQIRNHLKNTATSLGSTNLYGSGLVNAEAATR

SEQ ID NO: 308 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNIIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVDSTYPGSTYASLNGTSMATPHVAGAAALVKQKNPSWSNVQIRNHLKNTATSLGSTNLYGSGLVNAEAATR

SEQ ID NO: 309 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNLIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVDSTYPGSTYASLNGTSMATPHVAGAAALVKQKNPSWSNVQIRNHLKNTATSLGSTNLYGSGLVNAEAATR

SEQ ID NO: 310 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNPIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVDSTYPGSTYASLNGTSMATPHVAGAAALVKQKNPSWSNVQIRNHLKNTATSLGSTNLYGSGLVNAEAATR

SEQ ID NO: 311 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNCIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVASTYPGSTYASLNGTSMATPHVAGAAALVKQKNPSWSNVQIRNHLKNTATSLGSTNLYGSGLVNAEAATR

SEQ ID NO: 312 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNQIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVASTYPGSTYASLNGTSMATPHVAGAAALVKQKNPSWSNVQIRNHLKNTATSLGSTNLYGSGLVNAEAATR

SEQ ID NO: 313 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNAIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVDSTYPGSTYASLNGTSMATPHVAGAAALVKQKNPSWSNVQIRNHLKNTATSLGSTNLYGSGLVNAEAATR

SEQ ID NO: 314 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNCIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVDSTYPGSTYASLNGTSMATPHVAGAAALVKQKNPSWSNVQIRNHLKNTATSLGSTNLYGSGLVNAEAATR

SEQ ID NO: 315 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNEIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVDSTYPGSTYASLNGTSMATPHVAGAAALVKQKNPSWSNVQIRNHLKNTATSLGSTNLYGSGLVNAEAATR

SEQ ID NO: 316 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNGIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVDSTYPGSTYASLNGTSMATPHVAGAAALVKQKNPSWSNVQIRNHLKNTATSLGSTNLYGSGLVNAEAATR

SEQ ID NO: 317 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNMIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVDSTYPGSTYASLNGTSMATPHVAGAAALVKQKNPSWSNVQIRNHLKNTATSLGSTNLYGSGLVNAEAATR

SEQ ID NO: 318 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNMIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVHSTYPGSTYASLNGTSMATPHVAGAAALVKQKNPSWSNVQIRNHLKNTATSLGSTNLYGSGLVNAEAATR

SEQ ID NO: 319 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNAIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVHSTYPGSTYASLNGTSMATPHVAGAAALVKQKNPSWSNVQIRNHLKNTATSLGSTNLYGSGLVNAEAATR

SEQ ID NO: 320 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNHIGVLGVAPRAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVMSTYPGSTYASLNGTSMATPHVAGAAALVKQKNPSWSNVQIRNHLKNTATSLGSTNLYGSGLVNAEAATR

SEQ ID NO: 321 - protein, 269 aa, artificial sequence
  GG36 ;protease variant
AQVVPWGISRVQAPAAHNRGLTGRGVKVAVLDTGISTHPDLNIRGGASFVPGEPSTQDGNGHGTHVAGTIAALDNNIGVLGVAPDAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSMATPHVAGAAALVKQKNPSWSNVQIRNRLKNTATSLGSTNLYGSGLVNAEAATR

SEQ ID NO: 322 - protein, 269 aa, artificial sequence
  GG36 ;protease variant
AQSVPWGISRVQAPAAHNRGLTGLGVKVAVLDTGISTHPDLNIRGGASFVPGEPSTQDGNGHGTHVAGTIAALDNNIGVLGVAPDSELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVYSTWPGSTYASLNGTSMATPHVAGAAALVKQKNPSWSNVQIRNRLKNTATSLGSTNLYGSGLVNAEAATR

SEQ ID NO: 323 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNNIGVLGVAPDAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTWPGSTYASLNGTSMATPHVAGAAALVKQKNPSWSNVQIRNRLKNTATSLGSTNLYGSGLVNAEAATR

SEQ ID NO: 324 - protein, 269 aa, artificial sequence
  GG36 ;protease variant
AQIVPWGISRVQAPAAHNRGLTGSGVKVAVLDTGISTHPDLYIRGGASFVPGEPSTQDGNGHGTHVAGTIAALNNSIGVDGVAPSAELYAVKVLGASGSGSVSSIAQGLEWAGNNGMHVANLSLSSPSPSATLEQAVNSATSRGVLVVAASGNSGAGSISYPARYANAMAVGATDQNNNRASFSQYGAGLDIVAPGVNVQSTYPGSTYAYKNGTSMATPHVAGAAALVKQKNPSWSNVQIRNHLKNTATPLGSTNLYGSGLVNAEAATR

SEQ ID NO: 325 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLSSPSPSATLEQAVNSATSRGVLVVAASGNSGAGSISYPARYANAMAVGATDQNNNRASFSQYGAGLDIVAPGVNVQSTYPGSTYAYLNGTSMATPHVAGAAALVKQKNPSWSNVQIRNHLKNTATSLGSTNLYGSGLVNAEAATR

SEQ ID NO: 326 - protein, 269 aa, artificial sequence
  GG36 ;protease variant
AQVVPWGVSRVQAPAAHNRGLTGSGVKVAVLDTGISTHEDLNIRGGASFVPGEPSTQDGNGHGTHVAGTIAALDNSIGVLGVAPDAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYPGSTYKSLNGTSMATPHVAGAAALVKQKNPSWSNVQIRNHLKNTATSLGSTILYGSGLVNAEAATR

SEQ ID NO: 327 - protein, 269 aa, artificial sequence
  GG36 ;protease variant
AQVVPWGVSRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYIGSTYASLNGTSMATPHVAGAAALVKQKNPSWSNVQIRNHLKNTATSLGSTILYGSGLVNAEAATR

SEQ ID NO: 328 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPDAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYIGSTYASKNGTSMATPHVAGAAALVKQKNPSWSNVQIRNHLKNTATSLGSTNLYGSGLVNAEAATR

SEQ ID NO: 329 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNSIGVLGVAPSAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 330 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNSIGVLGVAPDAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 331 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNSIGVLGVAPSAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYIGSTYASLNGTSMATPHVAGAAALVKQKNPSWSNVQIRNHLKNTATSLGSTNLYGSGLVNAEAATR

SEQ ID NO: 332 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNSIGVLGVAPSAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTILYGSGLVNAEAATR

SEQ ID NO: 333 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 334 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 335 - protein, 269 aa, artificial sequence
  GG36 ;protease variant
AQVVPWGVSRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 336 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPDAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 337 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGRPSPSATLEQAVNSATSRGVLVVAASGNSGAGQISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 338 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYIGSTYASLNGTSMATPHVAGAAALVKQKNPSWSNVQIRNHLKNTATSLGSTNLYGSGLVNAEAATR

SEQ ID NO: 339 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYPPSTYASLNGTSMATPHVAGAAALVKQKNPSWSNVQIRNHLKNTATSLGSTNLYGSGLVNAEAATR

SEQ ID NO: 340 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYPGSTYKSLNGTSMATPHVAGAAALVKQKNPSWSNVQIRNHLKNTATSLGSTNLYGSGLVNAEAATR

SEQ ID NO: 341 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYPGSTYASKNGTSMATPHVAGAAALVKQKNPSWSNVQIRNHLKNTATSLGSTNLYGSGLVNAEAATR

SEQ ID NO: 342 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTILYGSGLVNAEAATR

SEQ ID NO: 343 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNQYGSGLVNAEAATR

SEQ ID NO: 344 - protein, 269 aa, artificial sequence
  GG36 ;protease variant
AQVVPWGVSRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 345 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPDAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 346 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGSPSPSATLEQAVNSATSRGVLVVAASGNSGAGQISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 347 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNLYGSGLVNAEAATR

SEQ ID NO: 348 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTYIGSTYASLNGTSMATPHVAGAAALVKQKNPSWSNVQIRNHLKNTATSLGSTNLYGSGLVNAEAATR

SEQ ID NO: 349 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTYPPSTYASLNGTSMATPHVAGAAALVKQKNPSWSNVQIRNHLKNTATSLGSTNLYGSGLVNAEAATR

SEQ ID NO: 350 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTYPGSTYKSLNGTSMATPHVAGAAALVKQKNPSWSNVQIRNHLKNTATSLGSTNLYGSGLVNAEAATR

SEQ ID NO: 351 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTYPGSTYASKNGTSMATPHVAGAAALVKQKNPSWSNVQIRNHLKNTATSLGSTNLYGSGLVNAEAATR

SEQ ID NO: 352 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTILYGSGLVNAEAATR

SEQ ID NO: 353 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNQYGSGLVNAEAATR

SEQ ID NO: 354 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNSIGVLGVAPSAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYPPSTYASLNGTSMATPHVAGAAALVKQKNPSWSNVQIRNHLKNTATSLGSTNLYGSGLVNAEAATR

SEQ ID NO: 355 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNSIGVLGVAPSAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNQYGSGLVNAEAATR

SEQ ID NO: 356 - protein, 269 aa, artificial sequence
  GG36 ;protease variant
AQSVPWGISRVQAPAAHNRGLWGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGRQAPSATLEQAVNSATSRGILVVAASGNSGAGSISYPARYANAMAVGATDQNNNRASFSQYGPGLDIVAPGVNVQSTYPGSTYVSLNGTSMATPHVAGAAALVKQKNPSWSNVQIRNHLKNTATSLGSTNLYGSGLVNADAATR

SEQ ID NO: 357 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGRQAPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 358 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGRQAPSATLEQAVNSATSRGILVVAASGNSGAGSISYPARYANAMAVGATDQNNNRASFSQYGPGLDIVAPGVNVQSTYPGSTYVSLNGTSMATPHVAGAAALVKQKNPSWSNVQIRNHLKNTATSLGSTNLYGSGLVNAEAATR

SEQ ID NO: 359 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGRQAPSATLEQAVNSATSRGILVVAASGNSGAGSISYPARYANAMAVGATDQNNNRASFSQYGPGLDIVAPGVNVQSTYPGSTYASLNGTSMATPHVAGAAALVKQKNPSWSNVQIRNHLKNTATSLGSTNLYGSGLVNADAATR

SEQ ID NO: 360 - protein, 269 aa, artificial sequence
  GG36 ;protease variant
AQSVPWGISRVQAPAAHNRGLWGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGRQAPSATLEQAVNSATSRGVLVVAASGNSGAGSISYPARYANAMAVGATDQNNNRASFSQYGAGLDIVAPGVNVQSTYPGSTYVSLNGTSMATPHVAGAAALVKQKNPSWSNVQIRNHLKNTATSLGSTNLYGSGLVNADAATR

SEQ ID NO: 361 - protein, 269 aa, artificial sequence
  GG36 ;protease variant
AQSVPWGISRVQAPAAHNRGLWGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGRQAPSATLEQAVNSATSRGVLVVAASGNSGAGSISYPARYANAMAVGATDQNNNRASFSQYGPGLDIVAPGVNVQSTYPGSTYASLNGTSMATPHVAGAAALVKQKNPSWSNVQIRNHLKNTATSLGSTNLYGSGLVNADAATR

SEQ ID NO: 362 - protein, 269 aa, artificial sequence
  GG36 ;protease variant
AQSVPWGISRVQAPAAHNRGLTGSGVKVAVLDTGISTHEDLNIRGGASFVPGEPSTQDGNGHGTHVAGTIAALDNGIGVLGVAPSAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNQYGSGLVNAEAATR

SEQ ID NO: 363 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTYPPSTYASKNGTSMATPHVAGAAALVKQKNPSWSNVQIRNHLKNTATSLGSTILYGSGLVNAEAATR

SEQ ID NO: 364 - protein, 269 aa, artificial sequence
  GG36 ;protease variant
AQSVPWGVSRVQAPAAHNRGLTGSGVKVAVLDTGISTHEDLNIRGGASFVPGEPSTQDGNGHGTHVAGTIAALDNGIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVYSTYPGSTYASKNGTSMATPHVAGAAALVKQKNPSWSNVQIRNHLKNTATSLGSTNLYGSGLVNAEAATR

SEQ ID NO: 365 - protein, 269 aa, artificial sequence
  GG36 ;protease variant
AQVVPWGVSRVQAPAAHNRGLTGSGVKVAVLDTGISTHPDLNIRGGASFVPGEPSTQDGNGHGTHVAGTIAALDNGIGVLGVAPDAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTYIGSTYKSLNGTSMATPHVAGAAALVKQKNPSWSNVQIRNHLKITATSLGSTNLYGSGLVNAEAATR

SEQ ID NO: 366 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGSPSPSATLEQAVNSATSRGVLVVAASGNSGAGQISYPARYANAMAVGATDQNNNRASFSQYGAGLDIVAPGVNVQSTYIGSTYASKNGTSMATPHVAGAAALVKQKNPSWSNVQIRNHLKNTATSLGSTILYGSGLVNAEAATR

SEQ ID NO: 367 - protein, 269 aa, artificial sequence
  GG36 ;protease variant
AQSVPWGVSRVQAPAAHNRGLTGSGVKVAVLDTGISTHPDLNIRGGASFVPGEPSTQDGNGHGTHVAGTIAALDNGIGVLGVAPSAELYAVKVLGASGSGSVSSIAQGLEWAGNNRMHVANLSLGSPSPSATLEQAVNSATSRGVLVVAASGNSGAGQISYPARYANAMAVGATDQNNNRASFSQYGAGLDIVAPGVNVYSTYPGSTYASLNGTSMATPHVAGAAALVKQKNPSWSNVQIRNHLKITATSLGSTILYGSGLVNAEAATR

SEQ ID NO: 368 - protein, 269 aa, artificial sequence
  GG36 ;protease variant
AQSVPWGVSRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTYIGSTYKSLNGTSMATPHVAGAAALVKQKNPSWSNVQIRNHLKNTATSLGSTILYGSGLVNAEAATR

SEQ ID NO: 369 - protein, 269 aa, artificial sequence
  GG36 ;protease variant
AQSVPWGVSRVQAPAAHNRGLTGSGVKVAVLDTGISTHEDLNIRGGASFVPGEPSTQDGNGHGTHVAGTIAALDNGIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVYSTYIGSTYKSLNGTSMATPHVAGAAALVKQKNPSWSNVQIRNHLKNTATSLGSTILYGSGLVNAEAATR

SEQ ID NO: 370 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNSIGVLGVAPSAELYAVKVLGASGSGSVSSIAQGLEWAGNNRMHVANLSLGSPSPSATLEQAVNSATSRGVLVVAASGNSGAGQISYPARYANAMAVGATDQNNNRASFSQYGAGLDIVAPGVNVQSTYPPSTYVSLNGTSMATPHVAGAAALVKQKNPSWSNVQIRNHLKNTATSLGSTNQYGSGLVNAEAATR

SEQ ID NO: 371 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNSIGVLGVAPDAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYIPSTYASLNGTSMATPHVAGAAALVKQKNPSWSNVQIRNHLKNTATSLGSTIQYGSGLVNAEAATR

SEQ ID NO: 372 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVYSTYIPSTYKSLNGTSMATPHVAGAAALVKQKNPSWSNVQIRNHLKNTATSLGSTILYGSGLVNAEAATR

SEQ ID NO: 373 - protein, 269 aa, artificial sequence
  GG36 ;protease variant
AQSVPWGVSRVQAPAAHNRGLTGSGVKVAVLDTGISTHEDLNIRGGASFVPGEPSTQDGNGHGTHVAGTIAALDNGIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTYPPSTYASKNGTSMATPHVAGAAALVKQKNPSWSNVQIRNHLKITATSLGSTILYGSGLVNAEAATR

SEQ ID NO: 374 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPDAELYAVKVLGASGSGSVSSIAQGLEWAGNNRMHVANLSLGRPSPSATLEQAVNSATSRGVLVVAASGNSGAGSISYPARYANAMAVGATDQNNNRASFSQYGAGLDIVAPGVNVQSTYIGSTYASKNGTSMATPHVAGAAALVKQKNPSWSNVQIRNHLKNTATSLGSTILYGSGLVNAEAATR

SEQ ID NO: 375 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNSIGVLGVAPSAELYAVKVLGASGSGSVSSIAQGLEWAGNNRMHVANLSLGSPSPSATLEQAVNSATSRGVLVVAASGNSGAGQISYPARYANAMAVGATDQNNNRASFSQYGAGLDIVAPGVNVQSTYIGSTYASLNGTSMATPHVAGAAALVKQKNPSKSNVQIRNHLKNTATSLGSTNQYGSGLVNAEAATR

SEQ ID NO: 376 - protein, 269 aa, artificial sequence
  GG36 ;protease variant
AQSVPWGVSRVQAPAAHNRGLTGSGVKVAVLDTGISTHPDLNIRGGASFVPGEPSTQDGNGHGTHVAGTIAALDNGIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTYIGSTYVSLNGTSMATPHVAGAAALVKQKNPSWSNVQIRNHLKNTATSLGSTILYGSGLVNAEAATR

SEQ ID NO: 377 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNGIGVLGVAPDAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVQSTYIGSTYVSKNGTSMATPHVAGAAALVKQKNPSWSNVQIRNHLKNTATSLGSTIQYGSGLVNAEAATR

SEQ ID NO: 378 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNGIGVLGVAPSAELYAVKVLGASGSGSVSSIAQGLEWAGNNRMHVANLSLGSPSPSATLEQAVNSATSRGVLVVAASGNSGAGSISYPARYANAMAVGATDQNNNRASFSQYGAGLDIVAPGVNVYSTYPGSTYASKNGTSMATPHVAGAAALVKQKNPSWSNVQIRNHLKNTATSLGSTNLYGSGLVNAEAATR

SEQ ID NO: 379 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNGIGVLGVAPSAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYPGSTYASKNGTSMATPHVAGAAALVKQKNPSWSNVQIRNHLKNTATSLGSTNLYGSGLVNAEAATR

SEQ ID NO: 380 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNGIGVLGVAPSAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTYIGSTYVSKNGTSMATPHVAGAAALVKQKNPSWSNVQIRNHLKNTATSLGSTNLYGSGLVNAEAATR

SEQ ID NO: 381 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPDAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVYSTYPGSTYASLNGTSMATPHVAGAAALVKQKNPSWSNVQIRNHLKNTATSLGSTNLYGSGLVNAEAATR

SEQ ID NO: 382 - protein, 269 aa, artificial sequence
  GG36 ;protease variant
AQVVPWGISRVQAPAAHNRGLTGSGVKVAVLDTGISTHEDLNIRGGASFVPGEPSTQDGNGHGTHVAGTIAALDNGIGVLGVAPSAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYPGSTYKSLNGTSMATPHVAGAAALVKQKNPSWSNVQIRNHLKNTATSLGSTILYGSGLVNAEAATR

SEQ ID NO: 383 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNSIGVLGVAPDAELYAVKVLGASGSGSVSSIAQGLEWAGNNRMHVANLSLGLQAPSATLEQAVNSATSRGVLVVAASGNSGAGSISYPARYANAMAVGATDQNNNRASFSQYGAGLDIVAPGVNVQSTYIGSTYASKNGTSMATPHVAGAAALVKQKNPSWSNVQIRNHLKNTATSLGSTNLYGSGLVNAEAATR

SEQ ID NO: 384 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNSIGVLGVAPRAELYAVKVLGASGSGSVSSIAQGLEWAGNNRMHVANLSLGKPSPSATLEQAVNSATSRGVLVTAASGNSGAGSISYPARYANAMAVGATDQNNNRASFSQYGAGLDIVAPGVNVQSTYPGSTYASKNGTSMATPHVAGAAALVKQKNPSWSNVQIRNHLKNTATSLGSTNLYGSGLVNAEAATR

SEQ ID NO: 385 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGKPSPSATLEQAVNSATSRGVLVTAASGNSGAGSISYPARYANAMAVGATDQNNNRASFSQYGAGLDIVAPGVNVQSTYPGSTYASKNGTSMATPHVAGAAALVKQKNPSWSNVQIRNHLKNTATSLGSTNLYGSGLVNAEAATR

SEQ ID NO: 386 - protein, 269 aa, artificial sequence
  GG36 ;protease variant
AQSVPWGISRVQAPAAHNRGLTGSGVKVAVLDTGISTHPDLNIRGGASFVPGEPSTQDGNGHGTHVAGTIAALDNNIGVLGVAPRAELYAVKVLGASGSGSVSSIAQGLEWAGNNRMHVANLSLGKPSPSATLEQAVNSATSRGVLVTAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 387 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNGIGVLGVAPDAELYAVKVLGASGSGSVSSIAQGLEWAGNNAMHVANLSLGSPSPSATLEQAVNSATSRGVLVVAASGNSGAGSINYPARYANAMAVGATDQNNNRASFSQYGPGLDIVAPGVNVMSTYIGSTYASLSGTSMATPHVAGAAALVKQKNPSWSNVQIRDHLKNTATSLGSTIQYGSGLVNAEAATR

SEQ ID NO: 388 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNGIGVLGVAPTAELYAVKVLGASGQGSVSSIAQGLEWAGNNAMHVANLSLGSPQPSATLEQAVNSATSRGVLVVAASGNSGAGSINYPARYANAMAVGATDQNNNRASFSQYGPGLDIVAPGVNVQSTYIGSTYASLSGTSMATPHVAGAAALVKQKNPSWSNVQIRDHLKNTATPLGSTILYGSGLVNAEAATR

SEQ ID NO: 389 - protein, 269 aa, artificial sequence
  GG36 ;protease variant
AQVVPWGISRVQAPAAHNRGLTGSGVKVAVLDTGISTHPDLNIRGGASFVPGEPSTQDGNGHGTHVAGTIAALDNGIGVLGVAPDAELYAVKVLGASGQGSVSSIAQGLEWAGNNAMHVANLSLGSPSPSATLEQAVNSATSRGVLVVAASGNSGAGSISYPARYANAMAVGATDQNNNRASFSQYGAGLDIVAPGVNVMSTYIGSTYASKSGTSQATPHVAGAAALVKQKNPSWSNVQIRDHLKNTATPLGSTNLYGSGLVNAEAATR

What is claimed is:

1. An isolated subtilisin variant comprising an amino acid sequence comprising a combination of amino acid substitutions X78N-X206L-X209W; wherein X is any amino acid and said variant has proteolytic activity; wherein said variant has at least 90% amino acid sequence identity to the amino acid sequence of SEQ ID NO: 1, and further wherein each amino acid position of said variant is numbered according to the corresponding amino acid position in the *Bacillus amyloliquefaciens* subtilisin BPN' sequence shown in SEQ ID NO:2 as determined by alignment of the variant amino acid sequence with the BPN' amino acid sequence.

2. The subtilisin variant of claim 1, wherein said variant has at least 95% amino acid sequence identity to SEQ ID NO:1.

3. The subtilisin variant of claim 1, wherein said variant has one or more improved property when compared to a parent or benchmark protease, wherein the improved property is selected from improved protease activity, improved cleaning performance in detergent, and improved thermostability in detergent.

4. The subtilisin variant of claim 3, wherein the parent protease is SEQ ID NO:1.

5. The isolated subtilisin variant of claim 3, wherein the improved property is
   (i) improved protease activity and said variant has a PI>1 on skim milk substrate;
   (ii) improved cleaning performance and said variant has an egg yolk swatch cleaning PI>1;
   (iii) improved thermostability and said variant has a stability PI>1; and/or
   (iv) improved thermostability and said variant has a residual activity ≥10%.

6. A composition comprising one or more subtilisin variant of claim 1, with the proviso that the composition is not an automatic dishwashing composition.

7. The composition of claim 6, wherein said composition is a detergent composition.

8. The composition of claim 6, wherein said composition is a laundry detergent composition or a hand dishwashing detergent composition.

9. The composition of claim 6, wherein said composition is selected from a gel, tablet, powder, solid, granule, unit dose, and combination thereof.

10. The composition of claim 6, wherein said composition further comprises one or more additional enzyme selected from hemicellulase, cellulase, amylase, peroxidase, protease, xylanase, lipase, phospholipase, esterase, cutinase, pectinase, pectate lyase, mannanase, keratinase, reductase, oxidase, phenoloxidase, lipoxygenase, ligninase, pullulanase, tannase, pentosanase, β-glucanase, arabinosidase, hyaluronidase, chondroitinase, and laccase.

* * * * *